US011739132B2

(12) United States Patent
Winston et al.

(10) Patent No.: US 11,739,132 B2
(45) Date of Patent: Aug. 29, 2023

(54) SEPARATION MOIETIES AND METHODS OF USE THEREOF

(71) Applicant: Werewolf Therapeutics, Inc., Cambridge, MA (US)

(72) Inventors: William Winston, West Newton, MA (US); Luke Evnin, San Francisco, CA (US); Vinay Bhaskar, San Francisco, CA (US); Giselle Knudsen, San Anselmo, CA (US); Daniel J. Hicklin, Boston, MA (US); Cynthia Seidel-Dugan, Belmont, MA (US); Jose Andres Salmeron Garcia, Acton, MA (US); Heather R. Brodkin, West Newton, MA (US)

(73) Assignee: Werewolf Therapeutics, Inc., Watertown, MA (US)

( * ) Notice: Subject to any disclaimer, the term of this patent is extended or adjusted under 35 U.S.C. 154(b) by 0 days.

(21) Appl. No.: 17/677,473

(22) Filed: Feb. 22, 2022

(65) Prior Publication Data
US 2022/0220181 A1 Jul. 14, 2022

Related U.S. Application Data

(63) Continuation of application No. 17/082,955, filed on Oct. 28, 2020, which is a continuation of application No. PCT/US2020/032988, filed on May 14, 2020.

(60) Provisional application No. 62/938,786, filed on Nov. 21, 2019, provisional application No. 62/847,914, filed on May 14, 2019.

(51) Int. Cl.
| C07K 14/715 | (2006.01) |
| C07K 14/55 | (2006.01) |
| C07K 16/28 | (2006.01) |
| C07K 14/57 | (2006.01) |
| A61K 39/00 | (2006.01) |
| A61K 47/64 | (2017.01) |
| C07K 14/52 | (2006.01) |

(52) U.S. Cl.
CPC .............. *C07K 14/55* (2013.01); *C07K 14/57* (2013.01); *C07K 14/7155* (2013.01); *C07K 16/2887* (2013.01); *A61K 47/642* (2017.08); *A61K 2039/505* (2013.01); *C07K 14/52* (2013.01); *C07K 2317/622* (2013.01); *C07K 2317/73* (2013.01); *C07K 2317/92* (2013.01); *C07K 2319/02* (2013.01); *C07K 2319/03* (2013.01); *C07K 2319/30* (2013.01); *C07K 2319/31* (2013.01); *C07K 2319/33* (2013.01); *C07K 2319/50* (2013.01); *C07K 2319/70* (2013.01)

(58) Field of Classification Search
None
See application file for complete search history.

(56) References Cited

U.S. PATENT DOCUMENTS

| 4,419,446 A | 12/1983 | Howley et al. |
| 4,560,655 A | 12/1985 | Baker |
| 4,601,978 A | 7/1986 | Karin |
| 4,657,866 A | 4/1987 | Kumar |
| 4,676,980 A | 6/1987 | Segal et al. |
| 4,767,704 A | 8/1988 | Cleveland |
| 4,816,567 A | 3/1989 | Cabilly et al. |
| 4,927,762 A | 5/1990 | Darfier |
| 4,965,199 A | 10/1990 | Capon et al. |
| 5,089,261 A | 2/1992 | Nitecki et al. |
| 5,122,464 A | 6/1992 | Wilson et al. |
| 5,122,469 A | 6/1992 | Mather et al. |
| 5,208,020 A | 5/1993 | Chari et al. |
| 5,264,365 A | 11/1993 | Georgiou |
| 5,288,931 A * | 2/1994 | Chang .................. C07K 1/1133 530/825 |
| 5,416,064 A | 5/1995 | Chari et al. |
| 5,508,192 A | 4/1996 | Georgiou et al. |
| 5,571,894 A | 11/1996 | Weis et al. |
| 5,587,458 A | 12/1996 | King et al. |
| 5,624,821 A | 4/1997 | Winter et al. |
| 5,635,483 A | 6/1997 | Pettit et al. |
| 5,639,635 A | 6/1997 | Joly et al. |
| 5,641,870 A | 6/1997 | Rinderknecht et al. |
| 5,648,237 A | 7/1997 | Carter et al. |
| 5,648,260 A | 7/1997 | Winter et al. |
| 5,712,374 A | 1/1998 | Kunstmann et al. |
| 5,714,586 A | 2/1998 | Kunstmann et al. |
| 5,739,277 A | 4/1998 | Presta et al. |
| 5,767,285 A | 6/1998 | Hamann et al. |
| 5,770,701 A | 6/1998 | McGahren et al. |

(Continued)

FOREIGN PATENT DOCUMENTS

| DE | 19701141 C1 | 4/1998 |
| EP | 547163 B1 | 2/2002 |

(Continued)

OTHER PUBLICATIONS

Tokuriki et al., 2009, Curr. Opin. Struc. Biol. 19:596-604.*
Alaoui-Ismaili, 2009, Cytokine Growth Factor Rev. 20(5-6):501-7.*
Ulloa-Aguirre et al, Traffic, 2004; vol. 5, pp. 821-837.*
Bernier et al, Curr. Opin. Pharmacol. 2004, vol. 4, pp. 528-533.*
Bhattacharya et al. 2017, PLoS ONE 12(3): e0171355.*
Puskas et al., "Development of an attenuated interleukin-2 fusion protein that can be activated by tumour-expressed proteases," Immunology, vol. 133, pp. 206-220 (2011).
Xue et al., "A tumor-specific pro-IL-12 activates preexisting cytotoxic T cells to control established tumors," Science Immunology, vol. 7, pp. 1-14 (2022).

(Continued)

*Primary Examiner* — Bridget E Bunner
*Assistant Examiner* — Fozia M Hamud
(74) *Attorney, Agent, or Firm* — Hogan Lovells US LLP

(57) ABSTRACT

Provided herein are separation moieties that are suitable for use in conjunction with a variety of therapeutic payloads. The separation moieties serve to generate conditionally active macromolecules whereby the macromolecules have reduced or minimal biological activity until the separation moieties are modified under specific conditions.

16 Claims, 94 Drawing Sheets

Specification includes a Sequence Listing.

(56) References Cited

U.S. PATENT DOCUMENTS

| | | | |
|---|---|---|---|
| 5,770,710 A | 6/1998 | McGahren et al. | |
| 5,773,001 A | 6/1998 | Hamann et al. | |
| 5,780,588 A | 7/1998 | Pettit et al. | |
| 5,834,597 A | 11/1998 | Tso et al. | |
| 5,869,046 A | 2/1999 | Presta et al. | |
| 5,877,296 A | 3/1999 | Hamann et al. | |
| 5,891,693 A | 4/1999 | Bebbington et al. | |
| 5,939,598 A | 8/1999 | Kucherlapati et al. | |
| 6,027,888 A | 2/2000 | Georgiou et al. | |
| 6,075,181 A | 6/2000 | Kucherlapati et al. | |
| 6,083,715 A | 7/2000 | Georgiou et al. | |
| 6,114,598 A | 9/2000 | Kucherlapati et al. | |
| 6,150,584 A | 11/2000 | Kucherlapati et al. | |
| 6,162,963 A | 12/2000 | Kucherlapati et al. | |
| 6,165,745 A | 12/2000 | Ward et al. | |
| 6,248,516 B1 | 6/2001 | Winter et al. | |
| 6,602,684 B1 | 8/2003 | Umana et al. | |
| 6,630,579 B2 | 10/2003 | Chari et al. | |
| 6,670,147 B1 | 12/2003 | Heidtman et al. | |
| 6,821,505 B2 | 11/2004 | Ward et al. | |
| 6,942,853 B2 | 9/2005 | Chernajovsky et al. | |
| 7,112,660 B1 * | 9/2006 | Domingues | A61P 37/08 424/85.2 |
| 7,498,298 B2 | 3/2009 | Doronina et al. | |
| 7,514,073 B2 | 4/2009 | Epstein et al. | |
| 8,399,219 B2 | 3/2013 | Stagliano et al. | |
| 8,563,269 B2 | 10/2013 | Stagliano et al. | |
| 8,734,774 B2 | 5/2014 | Frelinger et al. | |
| 8,809,504 B2 | 8/2014 | Lauermann et al. | |
| 8,969,538 B2 | 3/2015 | Rosen et al. | |
| 8,993,266 B2 | 3/2015 | Stagliano et al. | |
| 9,206,243 B2 | 12/2015 | Leon Monzon et al. | |
| 9,309,510 B2 | 4/2016 | La Porte et al. | |
| 9,453,078 B2 | 9/2016 | Stagliano et al. | |
| 9,487,590 B2 | 11/2016 | West et al. | |
| 9,517,276 B2 | 12/2016 | Lowman et al. | |
| 9,540,440 B2 | 1/2017 | Lowman et al. | |
| 9,644,016 B2 | 5/2017 | Stagliano et al. | |
| 9,708,412 B2 | 7/2017 | Baeuerle et al. | |
| 9,737,623 B2 | 8/2017 | Desnoyers et al. | |
| 9,775,913 B2 | 10/2017 | Lauermann | |
| 9,856,314 B2 | 1/2018 | Lowman et al. | |
| 9,861,705 B2 | 1/2018 | Bossard et al. | |
| 9,889,211 B2 | 2/2018 | Lowman et al. | |
| 10,059,762 B2 | 8/2018 | Stagliano et al. | |
| 10,077,300 B2 | 9/2018 | Daugherty et al. | |
| 10,100,106 B2 | 10/2018 | Dubridge et al. | |
| 10,138,272 B2 | 11/2018 | Moore et al. | |
| 10,179,817 B2 | 1/2019 | Sagert et al. | |
| 10,233,244 B2 | 3/2019 | Sagert et al. | |
| 10,301,380 B2 | 3/2019 | West et al. | |
| 10,261,083 B2 | 4/2019 | Vasiljeva et al. | |
| 10,513,549 B2 | 12/2019 | Stagliano et al. | |
| 2002/0164328 A1 | 11/2002 | Shinkawa et al. | |
| 2003/0045474 A1 * | 3/2003 | Sailer | A61K 38/1875 514/8.8 |
| 2003/0139575 A1 | 7/2003 | Gillies et al. | |
| 2003/0157108 A1 | 8/2003 | Presta et al. | |
| 2003/0190311 A1 | 10/2003 | Dall'Acqua et al. | |
| 2004/0014652 A1 | 1/2004 | Trouet et al. | |
| 2004/0093621 A1 | 5/2004 | Shitara et al. | |
| 2004/0109865 A1 | 6/2004 | Niwa et al. | |
| 2004/0110282 A1 | 6/2004 | Kanda et al. | |
| 2004/0110682 A1 | 6/2004 | Heidtmann et al. | |
| 2004/0132140 A1 | 7/2004 | Satoh et al. | |
| 2004/0136952 A1 | 7/2004 | Bhaskaran et al. | |
| 2005/0014934 A1 | 1/2005 | Hinton et al. | |
| 2006/0205926 A1 | 9/2006 | Ross et al. | |
| 2006/0236411 A1 | 10/2006 | Dreher et al. | |
| 2007/0048282 A1 | 3/2007 | Rosen et al. | |
| 2007/0269422 A1 | 11/2007 | Beirnaert et al. | |
| 2010/0254944 A1 | 10/2010 | Subramanian et al. | |
| 2011/0190209 A1 | 8/2011 | Culbertson et al. | |
| 2013/0064788 A1 | 3/2013 | Barnes et al. | |
| 2014/0154743 A1 * | 6/2014 | Levy | C07K 16/00 435/69.6 |
| 2015/0079088 A1 | 3/2015 | Lowman et al. | |
| 2015/0087810 A1 | 3/2015 | Moore et al. | |
| 2015/0113676 A1 | 4/2015 | Abad et al. | |
| 2016/0152686 A1 | 6/2016 | Camphausen et al. | |
| 2016/0194399 A1 | 7/2016 | Irving et al. | |
| 2016/0289324 A1 | 10/2016 | Moore et al. | |
| 2016/0311903 A1 | 10/2016 | West et al. | |
| 2016/0354472 A1 | 12/2016 | Merchant et al. | |
| 2016/0355587 A1 | 12/2016 | West et al. | |
| 2017/0044259 A1 | 2/2017 | Tipton et al. | |
| 2017/0096472 A1 | 4/2017 | Rosen et al. | |
| 2017/0240608 A1 | 8/2017 | Stagliano et al. | |
| 2018/0016316 A1 | 1/2018 | Garcia et al. | |
| 2018/0119128 A1 | 5/2018 | Metzner et al. | |
| 2018/0134789 A1 | 5/2018 | Baeuerle et al. | |
| 2018/0200346 A1 | 7/2018 | Ballance et al. | |
| 2018/0303952 A1 | 10/2018 | Sagert et al. | |
| 2018/0344810 A1 | 12/2018 | Addepalli et al. | |
| 2019/0008978 A1 | 1/2019 | Huang et al. | |
| 2019/0016814 A1 | 1/2019 | Humphrey et al. | |
| 2019/0117789 A1 | 4/2019 | Carman et al. | |
| 2019/0135943 A1 | 5/2019 | Boustany et al. | |
| 2019/0225702 A1 | 7/2019 | Baeuerle et al. | |

FOREIGN PATENT DOCUMENTS

| | | |
|---|---|---|
| EP | 1867660 A1 | 12/2007 |
| EP | 2639241 A2 | 9/2013 |
| EP | 3134102 A4 | 11/2017 |
| EP | 3792277 A1 | 3/2021 |
| WO | 1987/00195 | 1/1987 |
| WO | 1990/03430 | 4/1990 |
| WO | 1991/01743 | 2/1991 |
| WO | 1993/08829 | 5/1993 |
| WO | 1993/16185 | 8/1993 |
| WO | 1994/11026 | 5/1994 |
| WO | 199429351 | 12/1994 |
| WO | 1996027011 | 9/1996 |
| WO | 1997/30087 | 8/1997 |
| WO | 1998/58964 | 12/1998 |
| WO | 1999/22764 | 5/1999 |
| WO | 1999/51642 | 10/1999 |
| WO | 2000/61739 | 10/2000 |
| WO | 2001/30460 A1 | 5/2001 |
| WO | 2001/079271 A1 | 10/2001 |
| WO | 2002022833 A1 | 3/2002 |
| WO | 2002/43478 | 6/2002 |
| WO | 2002076489 | 10/2002 |
| WO | 2003/011878 | 2/2003 |
| WO | 2003/59934 A2 | 7/2003 |
| WO | 2003/084570 | 10/2003 |
| WO | 2003/085119 | 10/2003 |
| WO | 2003/106381 A2 | 12/2003 |
| WO | 2004/041865 | 5/2004 |
| WO | 2004/056312 | 7/2004 |
| WO | 2005/035586 | 4/2005 |
| WO | 2005/035778 | 4/2005 |
| WO | 2005/053742 | 6/2005 |
| WO | 20060166329 A1 | 7/2006 |
| WO | 2006/106905 A1 | 10/2006 |
| WO | 2006110728 A2 | 10/2006 |
| WO | 2008/147530 A1 | 12/2008 |
| WO | 2009103965 A1 | 8/2009 |
| WO | 2010020766 A2 | 2/2010 |
| WO | 2011011797 A2 | 1/2011 |
| WO | 2011/124718 | 10/2011 |
| WO | 2011123683 A2 | 10/2011 |
| WO | 2012/059486 | 5/2012 |
| WO | 2013163631 A2 | 10/2013 |
| WO | 20131771897 A2 | 11/2013 |
| WO | 2014100014 A1 | 6/2014 |
| WO | 2014/120555 A1 | 8/2014 |
| WO | 2015066279 A2 | 5/2015 |
| WO | 2016/200645 A1 | 12/2016 |
| WO | 2017156178 A1 | 9/2017 |
| WO | 2018/071918 | 4/2018 |
| WO | 2018071777 A1 | 4/2018 |

(56) References Cited

FOREIGN PATENT DOCUMENTS

| | | |
|---|---|---|
| WO | 2018136725 A1 | 4/2018 |
| WO | 2018160754 A2 | 9/2018 |
| WO | 2018160877 A1 | 9/2018 |
| WO | 2018/085555 A1 | 11/2018 |
| WO | 2018/204717 A1 | 11/2018 |
| WO | 2018204528 A1 | 11/2018 |
| WO | 2018204717 A1 | 11/2018 |
| WO | 2018213341 A1 | 11/2018 |
| WO | 2018236701 A1 | 12/2018 |
| WO | 2019/014586 A1 | 1/2019 |
| WO | 2019/018828 A1 | 1/2019 |
| WO | 2019036031 A2 | 2/2019 |
| WO | 2019094396 A1 | 5/2019 |
| WO | 2019/173832 A2 | 9/2019 |
| WO | 2019/214757 A1 | 11/2019 |
| WO | 2019/222294 A1 | 11/2019 |
| WO | 2019/222295 A1 | 11/2019 |
| WO | 2019/222296 A1 | 11/2019 |
| WO | 20192/22294 A1 | 11/2019 |
| WO | 2019222295 A1 | 11/2019 |
| WO | 2019/246392 | 12/2019 |
| WO | 2020/069398 A1 | 4/2020 |
| WO | 2020/252264 A1 | 12/2020 |
| WO | 2021/016599 A1 | 1/2021 |
| WO | 2021/030483 A1 | 2/2021 |
| WO | 2021202673 A1 | 7/2021 |
| WO | 2021202675 A1 | 7/2021 |
| WO | 2021202678 A1 | 10/2021 |

OTHER PUBLICATIONS

Xue et al., "Supplementary Materials for a tumor-specific pro-IL-12 activates preexisting cytotoxic T cells to control established tumors" Science Immunology, vol. 7, pp. 1-26, (2022).
Cao, et al, "Next generation of tumor-activating type I IFN enhances anti-tumor immune responses to overcome therapy resistance", Nature Communications, 12:5866, pp. 1-11 (2021).
Lin et al., Targeting Drug Conjugates to the Tumor Microenvironment: Probody Drug Conjugates, Innovations for Next-Generation Antibody-Drug Conjugates, 2018, 281-298, Humana Press, USA.
Wong et al., In vivo imaging of protease activity by Probody therapeutic activation, Biochimie, Nov. 4, 2015, 62-67, vol. 122, Elsevier, USA.
Desnoyers et al., Tumor-Specific Activation of an EGFR-Targeting Probody Enhances Therapeutic Index, Science Translational Medicine, Oct. 16, 2013, , vol. 5, Issue 207, American Association for the Advancement of Science, USA.
Lebeau et al., Imaging a functional tumorigenic biomarker in the transformed epithelium, PNAS, Jan. 2, 2013, 93-98, vol. 110, Issue 1, National Academy of Sciences, USA.
Jabaiah et al., Identification of protease exosite-interacting peptides that enhance substrate cleavage kinetics, Biol Chem., Sep. 2012, 933-941, vol. 393, Issue 9, ASBMB Publications, USA.
Erster et al., Site-specific targeting of antibody activity in vivo mediated by disease-associated proteases, Journal of Controlled Release, Aug. 10, 2012, 804-812, vol. 161, Issue 3, Elsevier, USA.
Drag et al., Emerging principles in protease-based drug discovery, Nat Rev Drug Discov., Nov. 5, 2010, 690-701, vol. 9, Issue 9, Springer Nature, USA.
Boulware et al., Evolutionary optimization of peptide substrates for proteases that exhibit rapid hydrolysis kinetics, Biotechnol Bioeng., Jun. 15, 2010, 339-46, vol. 106, Issue 3, Wiley, USA.
Darragh et al., Specific targeting of proteolytic activity for tumor detection in vivo, Cancer Res., Feb. 15, 2010, 1505-1512, vol. 70, Issue 5, AACR, USA.
Agard et al., Methods for the proteomic identification of protease substrates, Curr Opin Chem Biol., nPDec. 2009, 503-509, vol. 12, Issue 5-6, Elsevier, USA.
Ulisse et al., The urokinase plasminogen activator system: a target for anti-cancer therapy, Curr Cancer Drug Targets, Feb. 2009, 32-71, vol. 9, Issue 1, Bentham Science.
Vartak et al. Matrix metalloproteases: underutilized targets for drug delivery, J Drug Target, Jan. 2007, 1-20, vol. 15, Issue 1.
Uhland, Matriptase and its putative role in cancer, Cell Mol Life Sci., Dec. 2006, 2968-2978, vol. 63, Issue 24.
Boulware et al., Protease specificity determination by using cellular libraries of peptide substrates (CLiPS), PNAS, May 16, 2006, 7583-7588, vol. 103, Issue 20, National Academy of Sciences, USA.
Rice et al., Bacterial display using circularly permuted outer membrane protein OmpX yields high affinity peptide ligands, Protein Sci., 825-836, Apr. 2006, vol. 15, Issue 4, Wiley.
Declerck et al., Proteases, extracellular matrix, and cancer: a workshop of the path B study section, Am J Pathol., Apr. 2004, 1131-1139, vol. 164, Issue 4, Elsevier, USA.
Geletu et al., Effect of Caveolin-1 upon Stat3-ptyr705 levels in breast and lung carcinoma cells., Biochem Cell Biol., Apr. 15, 2019, 1-19, Canadian Science Publishing.
Vasiljeva et al., The multifaceted roles of tumor-associated proteases and harnessing their activity for prodrug activation, Biological Chemistry, Apr. 22, 2019, Walter de Gruyter GmbH, (abstract only).
Giesen et al., 8O89Zr-labeled anti-PD-L1 CX-072 PET imaging in human xenograft and syngeneic tumors, Annals of Oncology, Feb. 27, 2019, vol. 30, Issue Supplement 1, Oxford Academic.
Zhao et al., FGFR1P is a driver isoform of FGFR1 alternative splicing in breast cancer cells, Oncotarget, Jan. 1, 2019, 30-44, vol. 10, Issue 1, Impact Journals, LLC.
Osorio et al., Understanding and quantifying the immune microenvironment in hepatocellular carcinoma, Transl Gastroenterol Hepatol. Dec. 24, 2018, 3:107, AME Publishing Company.
Zavrsnik et al., Cystatin C deficiency suppresses tumor growth in a breast cancer model through decreased proliferation of tumor cells, Oncotarget, Apr. 24, 2017, 73793-73809, vol. 8, Issue 43, Impact Journals, LLC.
Manuale L. Penichet, "Antibody-cytokine fusion proteins for the therapy of cancer", Immunology, 2001, pp. 91-101.
Irving et al., A Clue to Antigen Receptor Tails, J Immunol, May 1, 2014, 4013-4014, vol. 192, Issue 9, the American Association of Immunologists, Inc., USA.
Polu et al., Probody therapeutics for targeting antibodies to diseased tissue, May 20, 2014, Expert Opinion on Biological Therapy, 1049-1053, vol. 14, Issue 8, Taylor & Francis Online.
Lebeau et al., Imaging Active Urokinase Plasminogen Activator in Prostate Cancer, Cancer Res, 1225-1235, vol. 75, Issue 7, AACR, USA (2015).
Pandya et al., PKCα Attenuates Jagged-1-Mediated Notch Signaling in ErbB-2-Positive Breast Cancer to Reverse Trastuzumab Resistance, Clin Cancer Res, 175-186, Jan. 1, 2016, vol. 22 Issue 1, AACR, USA.
Hoos et al., CCR 20th Anniversary Commentary: Immune-Related Response Criteria-Capturing Clinical Activity in Immuno-Oncology, Clin Cancer Res. Nov. 15, 2015, 4989-4991, vol. 21, Issue 22, American Association of Cancer Research, USA.
Adusumilli et al., New Cancer Immunotherapy Agents in Development: a report from an associated program of the 31stAnnual Meeting of the Society for Immunotherapy of Cancer, 2016, J Immunother Cancer, Jun. 20, 2017, 1-9, vol. 5, Issue 50, BioMed Central, USA.
Afonina et al., Proteolytic Processing of Interleukin-1 Family Cytokines: Variations on a Common Theme, Immunity Review Jun. 16, 2015, 991-1004, vol. 42, Issue 6, Elsevier, USA.
Halin et al., Synergistic Therapeutic Effects of a Tumor Targeting Antibody Fragment, Fused to Interleukin 12 and to Tumor Necrosis Factor α, Cancer Research, Jun. 2003, 3202-3210, vol. 63, Issue 12, AACR, USA.
Deluca et al., Potentiation of PD-L1 blockade with a potency-matched dual cytokine-antibody fusion protein leads to cancer eradication in BALB/c-derived tumors but not in other mouse strains, Cancer Immunol Immunother, Sep. 6, 2018, 1381-1391, vol. 67, Issue 9, Springer.
Fercher et al., Evolution of the magic bullet: Single chain antibody fragments for the targeted delivery of immunomodulatory proteins, Exp Biol Med, Jan. 2018, 166-183, vol. 243, Issue 2, Sage Journals.

(56) References Cited

OTHER PUBLICATIONS

De Luca et al., Potency-matched Dual Cytokine-Antibody Fusion Proteins for Cancer Therapy. Mol Cancer Ther, Nov. 2017, 2442-2451, vol. 16, Issue 11, AACR, USA.
Kim et al., Novel immunocytokine IL 12-SS1 (Fv) inhibits mesothelioma tumor growth in nude mice, PLoS One, Nov. 15, 2013, 1-11, vol. 8, Issue 11, PLOS.
Pedretti et al, Combination of temozolomide with immunocytokine F16-IL2 for the treatment of glioblastoma, Br J Cancer, Sep. 7, 2010, 827-836, vol. 103, Issue 6, SpringerNature, UK.
Kaspar et al., The antibody-mediated targeted delivery of interieukin-15 and GM-CSF to the tumor neovasculature inhibits tumor growth and metastasis, Cancer Res, May 15, 2007, 4940-4098, vol. 67 Issue 10, AACR. USA.
Mitsiades et al., Matrix Metalloproteinase-7-mediated Cleavage of Fas Ligand Protects Tumor Cells from Chemotherapeutic Drug Cytotoxicity, Cancer Research, Jan. 15, 2001, 577-581, vol. 61, AACR, USA.
John Puskas et al., Development of an attenuated interleukin-2 fusion protein that can be activated by tumour-expressed proteases, Jun. 23, 2011, Immunology, vol. 133, No. 2, pp. 206-220.
Denise Skrombolas et al., Challenges and developing solutions for increasing the benefits of IL-2 treatment in tumor therapy, Expert Review of Clinical Immunology, vol. 10, No. 2, Feb. 1, 2014, pp. 207-217.
William R. Strohl, Fusion Proteins for Half-Life Extension of Biologies as a Strategy to Make Biobetters, BioDrugs, vol. 29, No. 4, Jul. 16, 2015, pp. 215-239.
Rodrigo Vazquez-Lombardi et al., Molecular Engineering of Therapeutic Cytokines, Antibodies, vol. 2 no. 3, Jul. 3, 2013, pp. 426-451.
Bernett et al., "Potency-reduced IL 15/IL 15Ra heterodimeric Fe-fusions display enhanced in vivo activity through increased exposure," Xencor, AACR (2018) Abstract #5565.
Caescu et al., "Active site determinants of substrate recognition by the metalloproteinases TACE and ADAM10," Biochem. J., 424(1):79-88 (2010).
Lindmark et al., "Binding of immunoglobulins to protein A and immunoglobulin levels in mammalian sera," J. Immunol. Meth., 62:1-13 (1983).
Arie et al. "Chaperone function of FkpA, a heat shock prolyl isomerase, in the periplasm of *Escherichia coli*,", Mol. Micro biol. 39:199-210 (2001).
Atwell et al., "Stable heterodimers from remodeling the domain interface of a homodimer using a phage display library," J. Mol. Biol., 270(1):26-35 (1997).
Bachmann, Cellular and Molecular Biology, vol. 2 (Washington, D.C.: American Society for Microbiology), pp. 1190-1219 (1987_.
Barnes et al., "Methods for growth of cultured cells in serum-free medium," Anal. Biochem. 102:255 (1980).
Bass et al., "Hormone phage: an enrichment method for variant proteins with altered binding properties," Proteins, 8:309-314 (1990).
Boerner et al., "Production of antigen-specific human monoclonal antibodies from in vitro-primed human splenocytes," J. Immunol., 147: 86 (1991).
Brennan et al., "Preparation of bispecific antibodies by chemical recombination of monoclonal immunoglobulin G1 fragments," Science, 229:81 (1985).
Brodeur et al., Monoclonal Antibody Production Techniques and Applications, pp. 51-63 Marcel Dekker, Inc., New York, (1987).
Carter et al., "High level *Escherichia coli* expression and production of a bivalent humanized antibody fragment," BiofTechnology 10: 163-167 (1992).
Carter et al., "Bispecific human IgG by design," J. Immunol. Methods, 248: 7-15 (2001).
Chapman et al. "Therapeutic antibody fragments with prolonged in vivo half-lives," Nature Biotechnol., 17:780-783 (1999).
Chari et al., "Immunoconjugates containing novel maytansinoids: promising anticancer drugs," Cancer Res. 52:127-131 (1992).
Chen et al., "Chaperone activity of DsbC," J. Biol. Chem. 274:19601-19605 (1999).

Choe et al., "Fe-Binding Ligands of Immunoglobulin G: an Overview of High Affinity Proteins and Peptides," Materials 9(12): 994 (2016).
Cunningham and Wells, "High-resolution epitope mapping of hGH-receptor interactions by alanine-scanning mutagenesis," Science, 244:1081-1085 (1989).
Davies et al., "Antibody-antigen complexes," Annual Rev Biochem. 59:439-473, (1990).
Dennis et al., "Albumin binding as a general strategy for improving the pharmacokinetics of proteins," JBC 277(38):35035-35043 (2002).
Dubowchik et al., "Doxorubicin Immunoconjugates Containing Bivalent, Lysosomally-Cleavable Dipeptide Linkages," Bioorg. & Med. Chem. Letters 12:1529-1532 (2002).
Duncan and Winter, "The binding site for C1q on IgG," Nature 322:738-40 (1988).
Damodaran, "Protein PEGylation: an overview of chemistry and process considerations," European Pharmaceutical Review, 15(1): 18-26 (2010).
Firan, M., et al., "The MHC class I-related receptor, FcRn, plays an essential role in the maternofetal transfer of y-globulin in humans," Int. Immunol. 13: 993-1002 (2001).
Fishwild, D. et al.,"High-avidity human IgG kappa monoclonal antibodies from a novel strain of minilocus transgenic mice," Nature Biotechnology 14: 845-851 (1996).
Graham et al., "Characteristics of a human cell line transformed by DNA from human adenovirus type 5," J. Gen Virol. 36:59 (1977).
Gunasekaran et al., "Enhancing antibody Fe heterodimer formation through electrostatic steering effects: applications to bispecific molecules and monovalent IgG," J Biol Chem., 285(25): 19637-19646 (2010).
Guss et al., "Structure of the IgG-binding regions of streptococcal protein G.," EMBO J. 5:15671575 (1986).
Guyer et al., "Immunoglobulin Binding by Mouse Intestinal Epithelial Cell Receptors," J. Immunol. 117:587 (1976).
Ham et al., "Media and Growth Requirements," Meth. Enz. 58:44 (1979).
Hara et al., "Overproduction of Penicillin-Binding Protein 7 Suppresses Thermosensitive Growth Defect at Low Dsmolarity due to an spr Mutation of *Escherichia coli*," Microbial Drug Resistance, 2:63-72 (1996).
Hinman et al., "Preparation and characterization of monoclonal antibody conjugates of the calicheamicins: a novel and potent family of antitumor antibiotics," Cancer Res. 53:3336-3342 (1993).
Hudson et al., "Engineered antibodies," Nat. Med., 9:129-134 (2003).
Idusogie et al., "Mapping of the C1q Binding Site on Rituxan, a Chimeric Antibody with a Human IgG1 Fe," J. Immunol., 164:4178-4184, (2000).
Imai-Nishiya et al., "Double knockdown of a1 ,6-fucosyltransferase (FUT8) and GDP-mannose 4,6-dehydratase (GMD) in antibody-producing cells: a new strategy for generating fully non-fucosylated therapeutic antibodies with enhanced ADCC," BMC Biotechnol., 7:84, 13 pages (2007).
Jefferis et al., "Human immunoglobulin allotypes: Possible implications for immunogenicity," mAbs, 1 (4):332-8 (2009).
Jeffrey et al., "Dipeptide-based highly potent doxorubicin antibody conjugates," Bioorganic & Med. Chem. Letters, 16:358-362 (2006).
Jones et al., "Replacing the complementarity-determining regions in a human antibody with those from a mouse," Nature, 321 :522-525 (1986).
Kim et al., "Localization of the site of the murine IgG1 molecule that is involved in binding to the murine intestinal Fe receptor," European Journal of Immunology, 24:2429-2434 (1994).
King et al., "Monoclonal Antibody Conjugates of Doxorubicin Prepared with Branched Peptide Linkers: Inhibition of Aggregation by Methoxytriethyleneglycol Chains," J. Med. Chem., 45:4336-4343 (2002).
Klein et al., "Progress in overcoming the chain association issue in bispecific heterodimeric IgG antibodies," MAbs, 4(6):653-663 (2012).
Kontermann et al., "Bispecific antibodies," Drug Discovery Today, 20(7) :838-84 7 (2015).
Kozbor et al., "A human hybrid myeloma for production of human monoclonal antibodies," J. Immunol., 133:3001-5 (1984).

(56) References Cited

OTHER PUBLICATIONS

Kratz et al., "Prodrugs of anthracyclines in cancer chemotherapy," Current Med. Chem. 13:477-523 (2006).
Krieg et al., "Improved IL-2 immunotherapy by selective stimulation of IL-2 receptors on lymphocytes and endothelial cells," PNAS, 107(26):11906-11911 (2010).
Lehninger, in Biochemistry, second ed., pp. 73-75, Worth Publishers, New York (1975).
Lode et al., "Targeted Therapy with a Novel Enediyene Antibiotic Calicheamicin theta(I) Effectively Suppresses Growth and Dissemination of Liver Metastases in a Syngeneic Model of Murine Neuroblastoma," Cancer Res., 58:2925-2928 (1998).
Trinchieri et al "The IL-2 family of heterodimeric cytokines: new players in the regulation of T cell responses." Immunity 2003; 19: 641-644.
Gillies, et al "Improved circulating half-life and efficacy of an antibody-interleukin 2 immunocytokine based on reduced intracellular proteolysis" Clinical Cancer Research, the American Association for Cancer Research, US, 8(1) Jan. 2002, 210-216.
Helguera, et al "Antibody-Cytokine fusion proteins: Harnessing the combined power of cytokines and antibodies for cancer therapy" Clinical immunology 105 (3) Dec. 2002, 233-246.
Jana et al "Interleukin-12 (IL-12), but not IL-23, induces the expression of IL-7 in microglia and macrophages: implications for multiple sclerosis." Immunology 2013; 141: 549-563.
Wang et al Structure of the Quaternary Complex of Interleukin-2 with its alpha, beta, and gamma-c receptors. Science Nov. 18, 2005 vol. 310, 1159-1163.
Lasek et al "Interleukin 12: still a promising candidate for tumor immunotherapy?" Cancer Immunol Immunother (2014) 63:419-435.
Montepaone et al "Profile of ustekinumab and its potential in the treatment of active psoriatic arthritis" Open Access Rheumatol. 2014; 6: 7-13.
Gerber et al Preferential attachment of peritoneal tumor metastases to omental immune aggregates and possible role of a unique vascular microenvironment in metastatic survival and growth. Am J Pathol 169(5): 1739-1752.
Marks-Konczalik et al "IL-2-induced cell death is inhibited in IL-15 transgenic mice." PNAS 2000; 97(21): 11445-11450.
Sadlack et al "Ulcerative colitis-like disease in mice with a disrupted interleukin 2 gene." Cell 1993; 75: 253-261.
Rochman et al. "New insights into the regulation of T cells by gamma-c family cytokines." Nat Rev Immunol 2009; 9(7): 480.
Hemar et al "Endocytosis of Interleukin 2 receptors in human T lymphocytes: distinct intracellular localization and fate of the receptor alpha, beta, and gamma chains." J. Cell Biol. 1995; 129(1): 55-64.
Gao et al "High-throughput screening using patient-derived tumor xenografts to predict clinical trial drug response." Nature Medicine 2015; 21(11): 1318-1325.
Suzuki et al. "Deregulated T cell activation and autoimmunity in Mice lacking interleukin-2 Receptor Beta." Science 1995; 268: 1472-1476.
Koreth et al "Interleukin-2 and Regulatory T Cells in Graft-versus-host disease." N. Engl. J. Med. 2011; 365(22): 2055-2066.
Saadoun, et al. "Regulatory T-Cell Responses to Low-Dose Interleukin-2 in HCV-Induced Vasculitis." N. Engl. J. Med. 2011; 365(22): 2067-2077.
Smith, T.F. and Waterman, M.S. "Comparison of biosequences." Advances in applied mathermatics 1981; 2: 482-489.
Willerford, et al "Interleukin-2 receptor alpha chain regulates the size and content of the peripheral lymphoid compartment." Immunity 1995; 3: 521-530.
Yu, A and Malek, T.R. "The Proteosome regulates receptor-mediated endocytosis of interleukin-2" the Journal of Biological Chemistry 2001; 276(1): 381-385.
Bessard et al High antitumor activity of RLI, an interleukin-15 (IL-15)-IL-15 receptor alpha fusion protein, in metastatic melanoma and colorectal cancer. Mol Cancer Ther 2009; 8(9): 2736-2745.

Desbois et al IL-15 Trans-signaling with the superagonist RLI Promotes Effector/Memory CD8+ T cell responses and enhances antitumor activity of PD-1 antagonists. 2016 J Immunol 1-11.
Malek, T.R. and Castro, I. Interleukin-2 receptor signaling: at the interface between tolerance and immunity. Immunity 2010 33(2): 153-165.
Berger et al "An Operational definition of epigenetics." Genes Dev 2009; 23: 781-783.
Klatzmann, D and Abbas, A.K. "The promise of low-dose interleukin-2 therapy for autoimmune and inflammatory diseases." Nat. Rev. Immunol. 2015; 15: 283-294.
Oh et al "IL-15 as a mediator of CD4+ help for CD8+ T cell longevity and avoidance of TRAIL-mediated apoptosis." PNAS 2008; 105(13): 5201-5206.
Berger et al "Safety and immunologic effects of IL-15 administration in nonhuman primates." Blood 2009; 114(12): 2417-2426.
Conlon et al "Redistribution, hyperproliferation, activation of natural killer cells and CD8 T cells, and cytokine production during first-in-human clinical trial of recombinant human interleukin-15 in patients with cancer." J Clin Oncol 2015; 33(1): 74-82.
Skrombolas, et al. "Development of Protease Activated Interleukin-12 Cytokine Fusion Proteins for Tumor Immunotherapy (TUM7P. 946)," the Journal of Immunology; 203:28, 192 (1 Supplement) (2014).
Skrombolas, et al. "Development of an Interleukin-12 Fusion Protein That Is Activated by Cleavage with Matrix Metalloproteinase 9," Journal of Interferon & Cytokine Research, 39(4):233-245 (2019).
Chen, et al., "Fusion Protein Linkers: Property, Design and Functionality", Adv. Drug Deliv Rev. (2013), 65(10), 1357-1369.
Santos, et al., "Computational prediction of protein aggregation: Advances in proteomics, conformation-specific algorithms and biotechnological applications", Computational and Structural Biotechnology Journal 18 (2020), 1403-1413.
Lonberg, et al., "Antigen-specific human antibodies from mice comprising four distinct genetic modifications," Nature 368:856-859 (1994).
Miather et al., "Culture of testicular cells in hormone-supplemented serum-free medium," Annals N.Y. Acad. Sci., 383:44-68 (1982).
Mather, "Establishment and characterization of two distinct mouse testicular epithelial cell lines," Biol. Reprod. 23:243-251 (1980).
Merchant et al., "An efficient route to human bispecific IgG," Nat. Biotechnol., 16(7):677-681 (1988).
Milstein et al., "Hybrid hybridomas and their use in immunohistochemistry," Nature, 305:537 (1983).
Moore et al. "A novel bispecific antibody format enables simultaneous bivalent and monovalent co-engagement of distinct target antigens," MAbs., 3(6): 546-557 (2011).
Mori et al., "Engineering Chinese hamster ovary cells to maximize effector function of produced antibodies using FUT8 siRNA," Biotechnol. Bioeng. 88(7):901-908 (2004).
Morimoto et al., "Single-step purification of F(ab12 fragments of mouse monoclonal antibodies (immunoglobulins G1) by hydrophobic interaction high performance liquid chromatography using TSKgel Phenyl-5PW," Journal of Biochemical and Biophysical Methods, 24:107-117 (1992).
Nagy et al., ("Stability of cytotoxic luteinizing hormone-releasing hormone conjugate (AN-152) containing doxorubicin 14-O-hemiglutarate in mouse and human serum in vitro: Implications for the design of preclinical studies," Proc. Natl. Acad. Sci. USA, 97:829-834 (2000).
Nilvebrant et al., "The albumin-binding domain as a scaffold for protein engineering," Comput. Struct. Biotechnol. J., 6:e201303009, 8 pages (2013).
Nygren et al., "Analysis and use of the serum albumin binding domains of streptococcal protein G," J. Mal. Recogn., 1 (2):69-74 (1988).
Okazaki et al., "Fucose depletion from human IgG1 oligosaccharide enhances binding enthalpy and association rate between IgG1 and FcgammaRIIIa," J. Mal. Biol., 336:1239-1249 (2004).
Omasa et al., "Decrease in antithrombin III fucosylation by expressing GDP-fucose transporter siRNA in Chinese hamster ovary cells," J. Biosci. Bioeng., 106(2):168-173 (2008).

(56) References Cited

OTHER PUBLICATIONS

Podust et al., "Extension of in vivo half-life of biologically active molecules by XTEN protein polymers," J. Controlled Release, 240:52-66 (2016).
Proba et al., "Functional antibody single-chain fragments from the cytoplasm of *Escherichia coli*: influence of thioredoxin reductase (TrxB)," Gene, 159:203-207 (1995).
Ramm et al., "The periplasmic *Escherichia coli* peptidylprolyl cis, trans-isomerase FkpA II. Isomerase-independent chaperone activity in vitro," J. Biol. Chem., 275:17106-17113 (2000).
Reyes et al., "Expression of human 13-interferon cDNA under the control of a thymidine kinase promoter from herpes simplex virus," Nature, 297:598-601 (1982).
Riechmann et al.,"Reshaping human antibodies for therapy," Nature, 332:323-327 (1988).
Ridgway et al., "'Knobs-into-holes' engineering of antibody CH3 domains for heavy chain heterodimerization," Protein Eng., 9(7):617-621 (1996).
Ripka et al., "Two Chinese hamster ovary glycosylation mutants affected in the conversion of GDP-man nose to GDP-fucose," Arch. Biochem. Biophys., 249:533-545 (1986).
Roux et al., "Comparisons of the ability of human IgG3 hinge mutants, IgM, IgE, and IgA2, to form small immune complexes: a role for flexibility and geometry," J Immunol, 161 :4083-90 (1998).
Sali et al., "Characterization of a Novel Human-Specific STING Agonist that Elicits Antiviral Activity Against Emerging Alphaviruses," PloS Pathog., 11(12):e1005324, 30 pages (2015).
Schlapschy et al., "PASylation: a biological alternative to PEGylation for extending the plasma half-life of pharmaceutically active proteins," Protein Eng. Des. Sel., 26(8):489-501 (2013).
Shields et al., High resolution mapping of the binding site on human IgG1 for Fe gamma RI, Fe gamma RII, Fe gamma RIII, and FcRn and design of IgG1 variants with improved binding to the Fe gamma R, J. Biol. Chem., 276:6591-6604. (2001).
Shields et al., "Lack of fucose on human IgG1 N-linked oligosaccharide improves binding to human Fcgamma RIii and antibody-dependent cellular toxicity," J. Biol. Chem., 277(30):26733-40 (2002).
Shinkawa et al., "The absence of fucose but not the presence of galactose or bisecting N-acetylglucosamine of human IgG1 complex-type oligosaccharides shows the critical role of enhancing antibody-dependent cellular cytotoxicity," J. Biol. Chem., 278(5):3466-73 (2003).

Simmons et al., "Expression of full-length immunoglobulins in *Escherichia coli*: rapid and efficient production of aglycosylated antibodies," J. Immunol. Methods, 263:133-147 (2002).
Sola et al. "Modulation of protein biophysical properties by chemical glycosylation: biochemical insights and biomedical implications," Cell. Mol. Life Sci., 64(16):2133-2152 (2007).
Sola et al., "Effects of Glycosylation on the Stability of Protein Pharmaceuticals," J. Pharm. Sci., 98(4):1223-1245 (2009).
Sties et al. (eds), Basic and Clinical Immunology, 8th Edition, Appleton & Lange, Nmwalk, CT, p. 71 and Chapter 6 (1994).
Suresh et al., "Bispecific monoclonal antibodies from hybrid hybridomas," Methods in Enzymology, 121:210-228 (1986).
Tomizuka et al., "Double trans-chromosomic mice: Maintenance of two individual human chromosome fragments containing Ig heavy and K loci and expression of fully human antibodies," Proc. Natl. Acad. Sci. USA, 97:722-727 (2000).
Torgov et al., "Generation of an Intensely Potent Anthracycline by a Monoclonal Antibody-[3-Galactosidase Conjugate," Bioconj. Chem., 16:717-721 (2005).
Traunecker et al., "Bispecific single chain molecules (Janusins) target cytotoxic lymphocytes on HIV infected cells," EMBO J., 10:3655-3656 (1991).
Urlaub et al., "Isolation of Chinese hamster cell mutants deficient in dihydrofolate reductase activity," Proc. Natl. Acad. Sci. USA, 77:4216-4220 (1980).
Verhoeven et al., "Reshaping human antibodies: grafting an antilysozyme activity," Science, 239:1534-1536 (1988).
Vitetta et al., "Redesigning nature's poisons to create anti-tumor reagents," Science, 238:1098-1104 (1987).
Yamane-Ohnuki et al., "Establishment of FUT8 knockout Chinese hamster ovary cells: an ideal host cell line for producing completely defucosylated antibodies with enhanced antibody-dependent cellular cytotoxicity," Biotech. Bioeng., 87:614-22 (2004).
Yamane-Ohnuki et al., "Production of therapeutic antibodies with controlled fucosylation," MAbs, 1 (3):230-236 (2009).
Yaniv, "Enhancing elements for activation of eukaryotic promoters," Nature 297:17-18 (1982).
Yeung et al.,"Engineering Human IgG1 Affinity to Human Neonatal Fe Receptor: Impact of Affinity Improvement on Pharmacokinetics in Primates," J. Immunol., 182:7667-7671 (2009).
Zapata et al., "Engineering linear F(ab')2 fragments for efficient production in *Escherichia coli* and enhanced antiproliferative activity," Protein Eng., 8(10):1057-1062 (1995).

\* cited by examiner

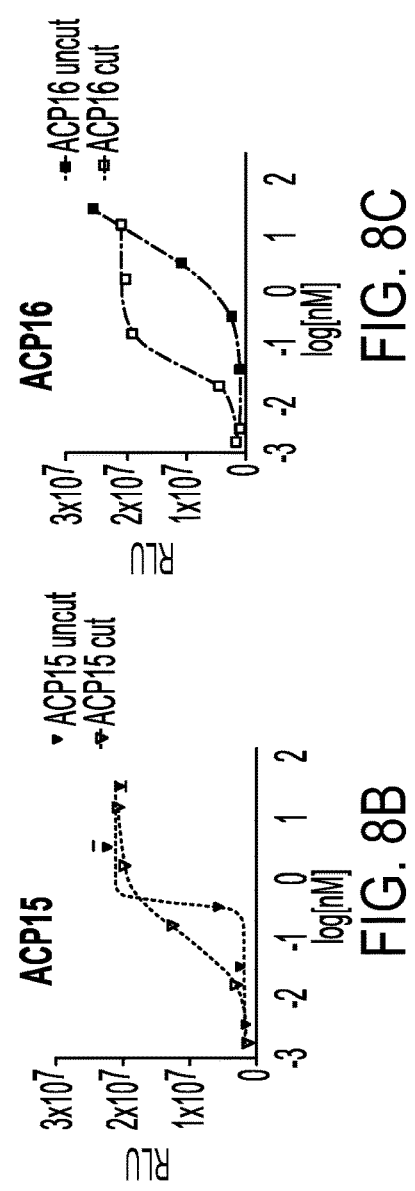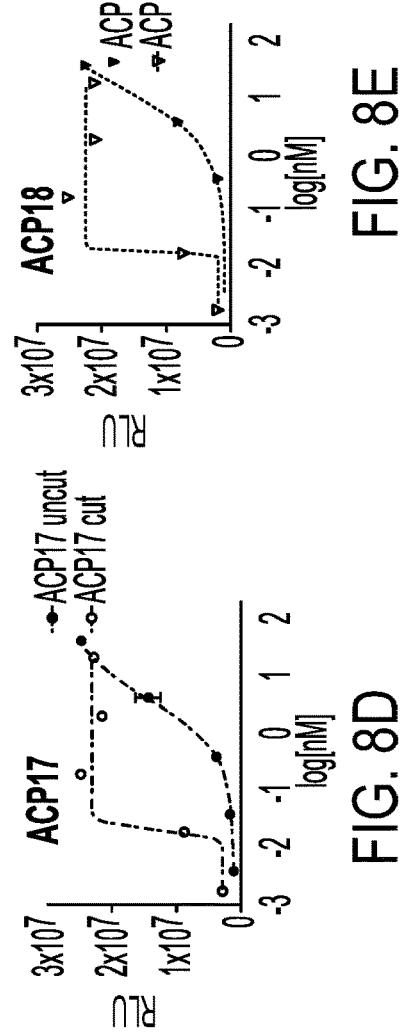

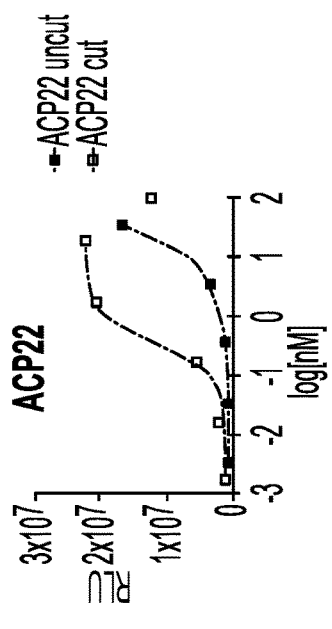
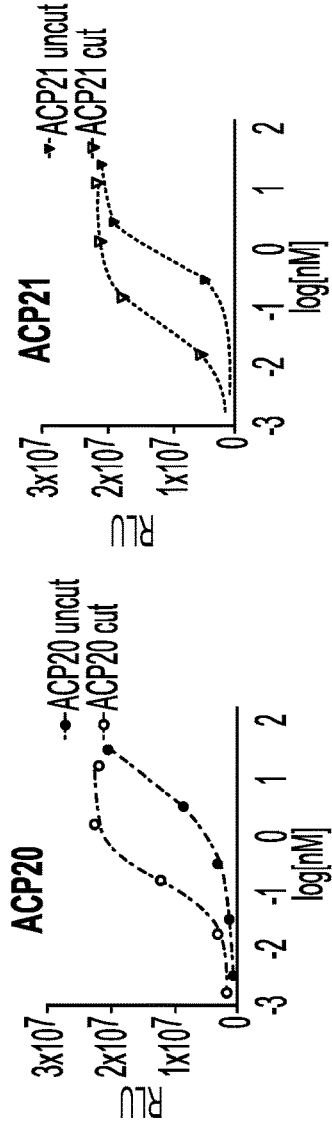
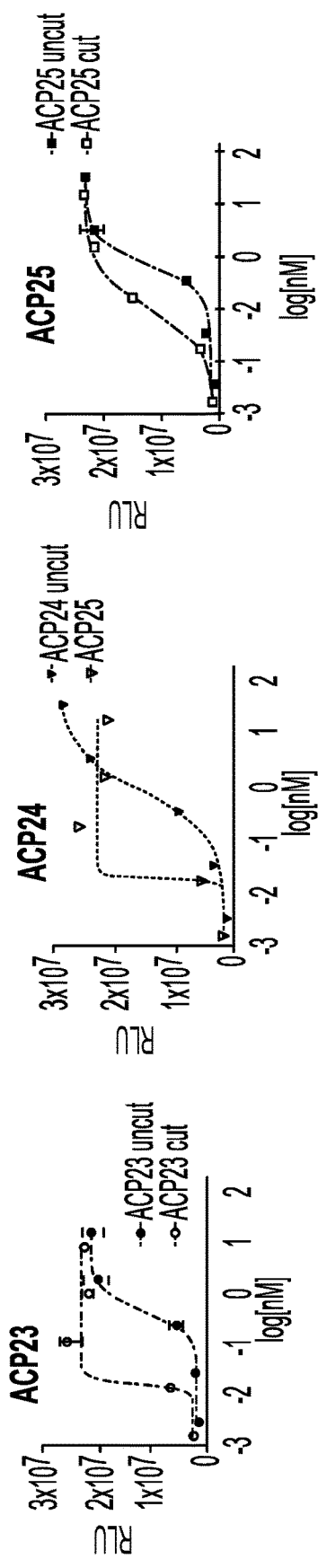
FIG. 9A  FIG. 9B  FIG. 9C
FIG. 9D  FIG. 9E  FIG. 9F

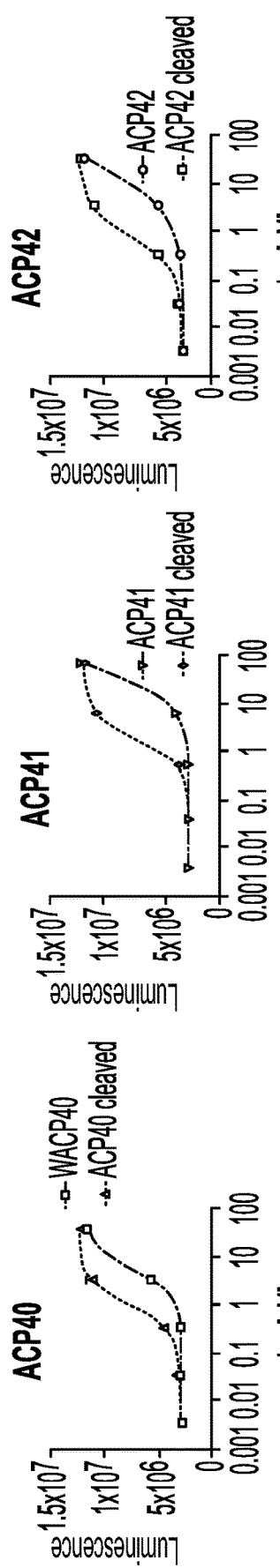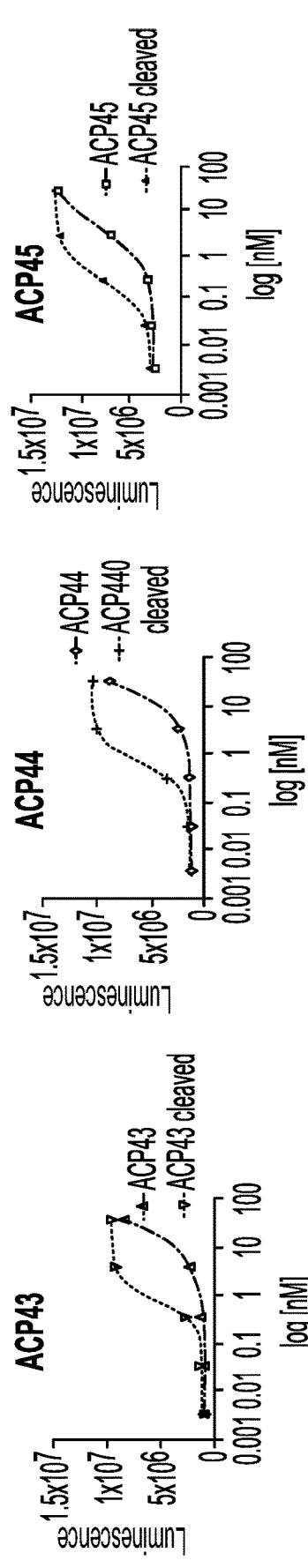

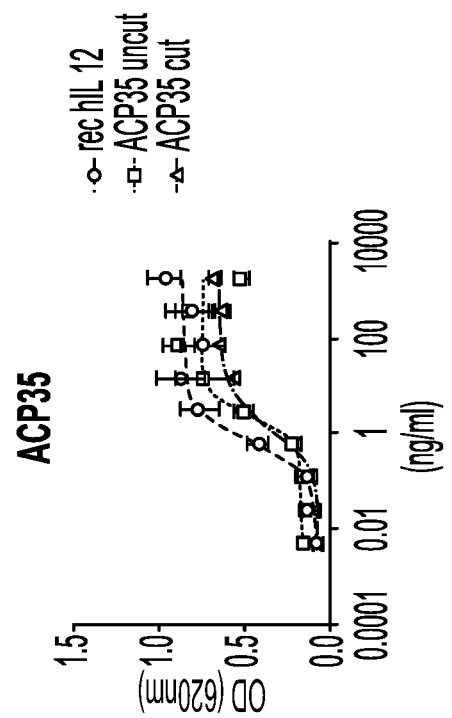
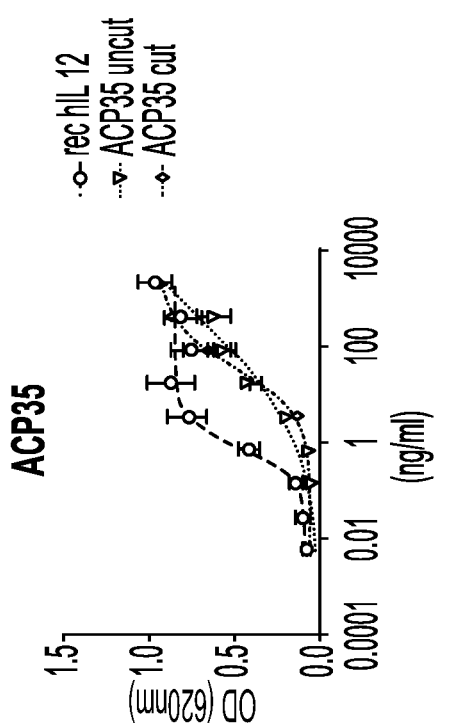
FIG. 11A
FIG. 11B

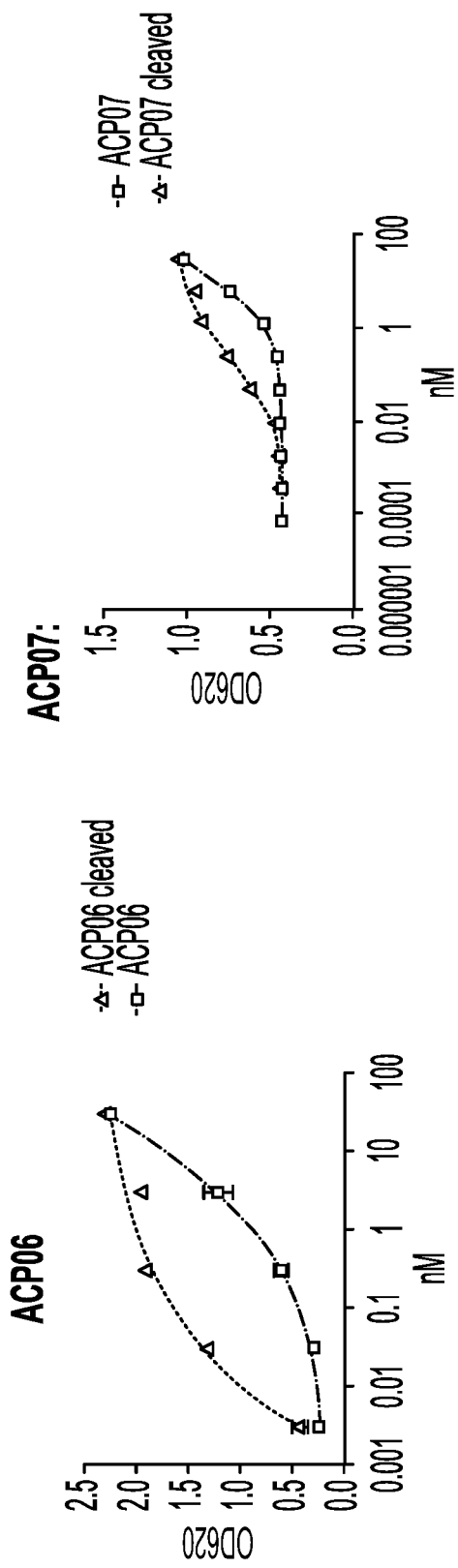
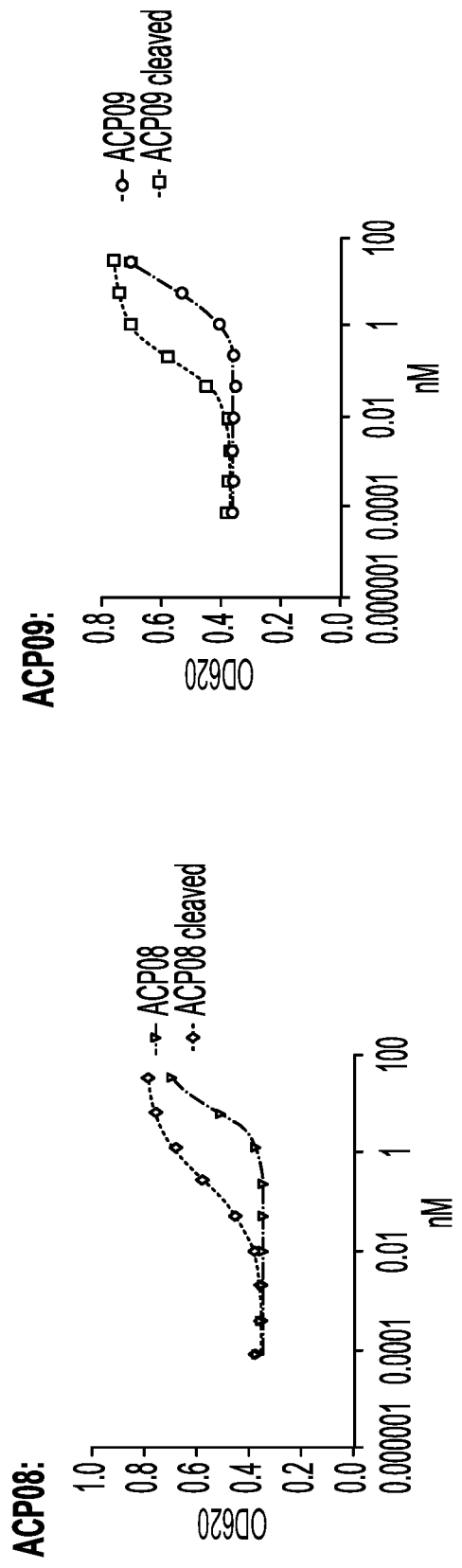

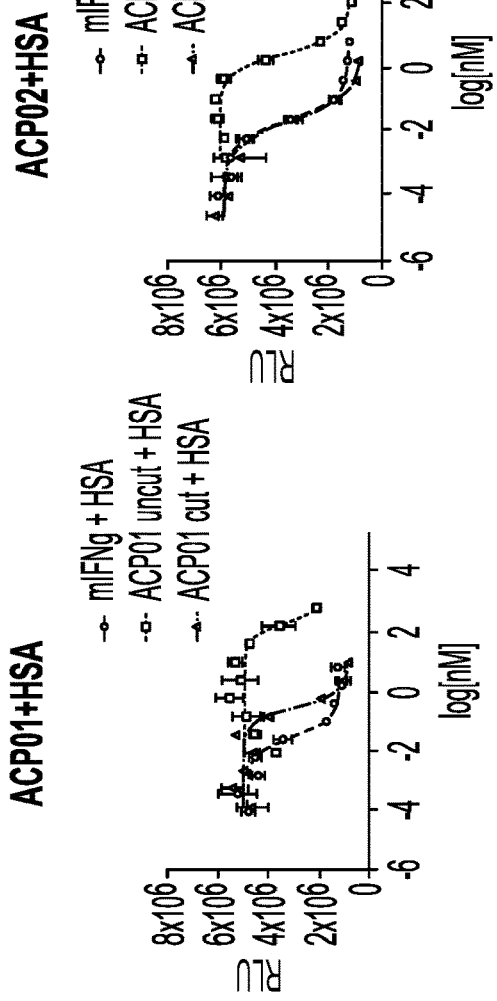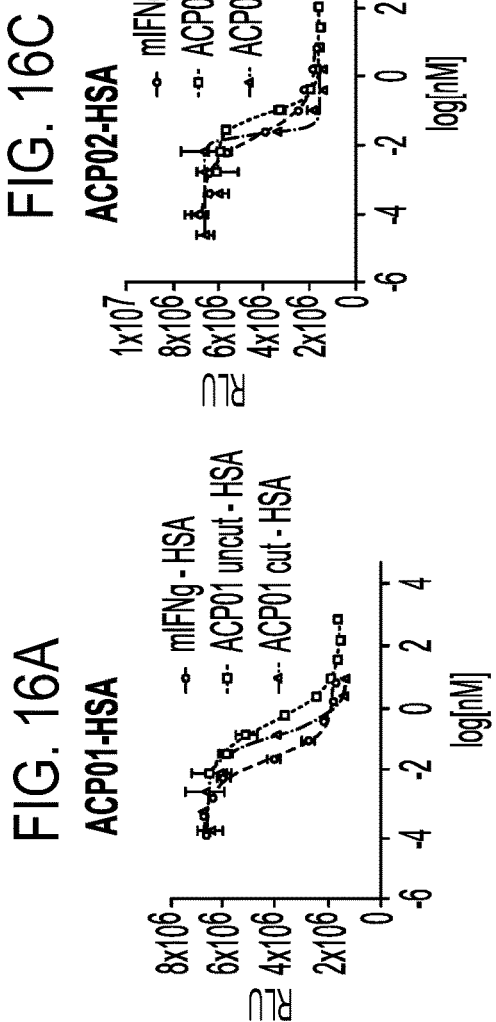

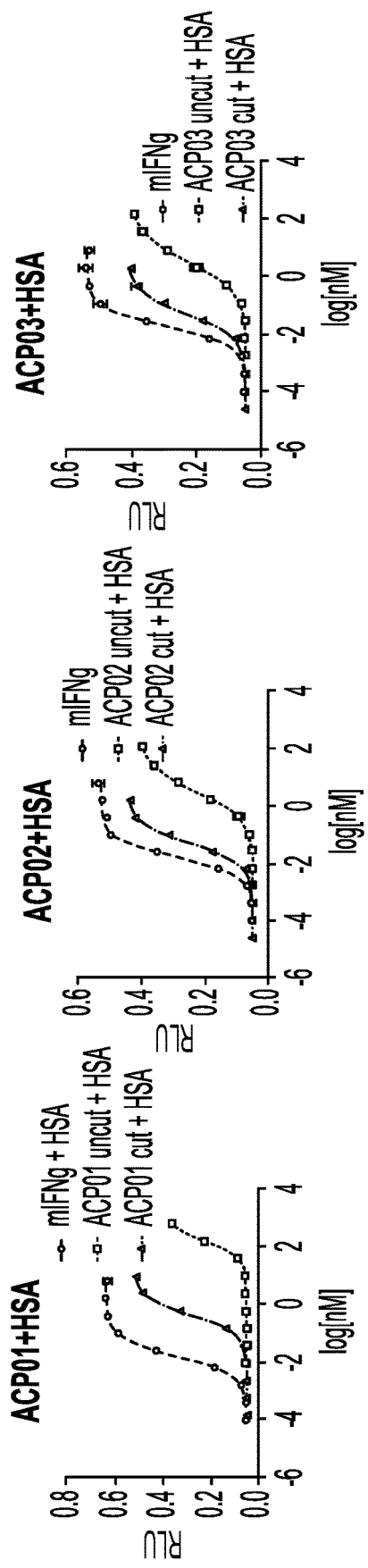

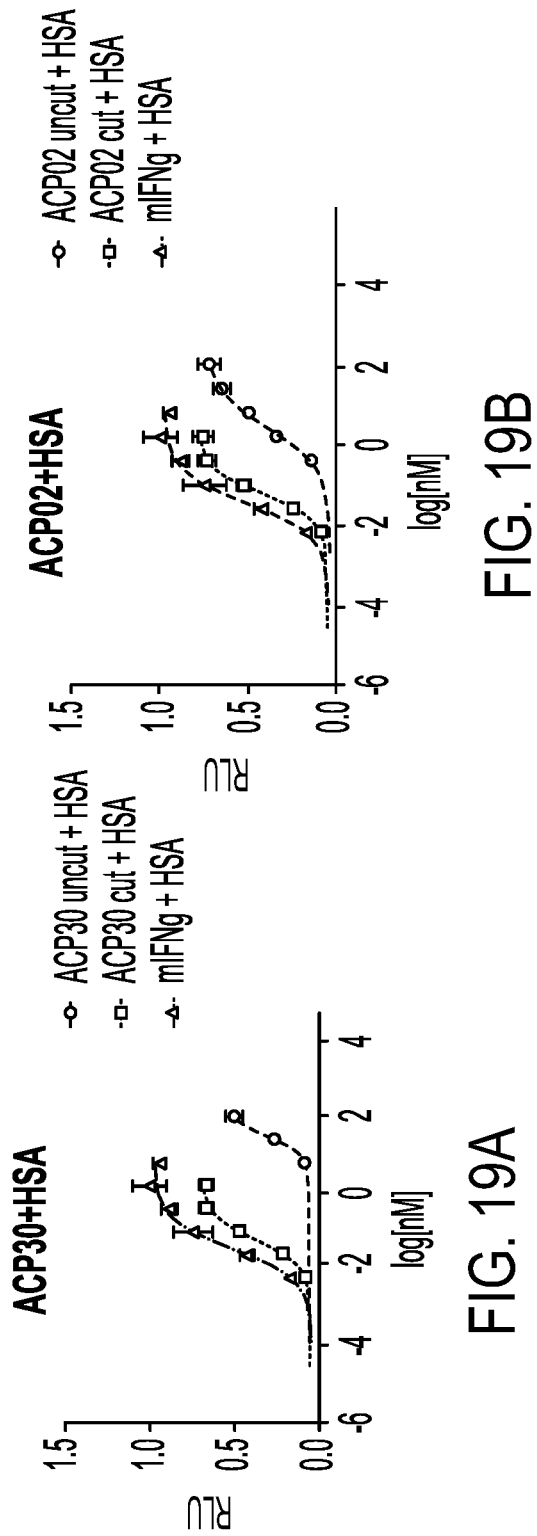

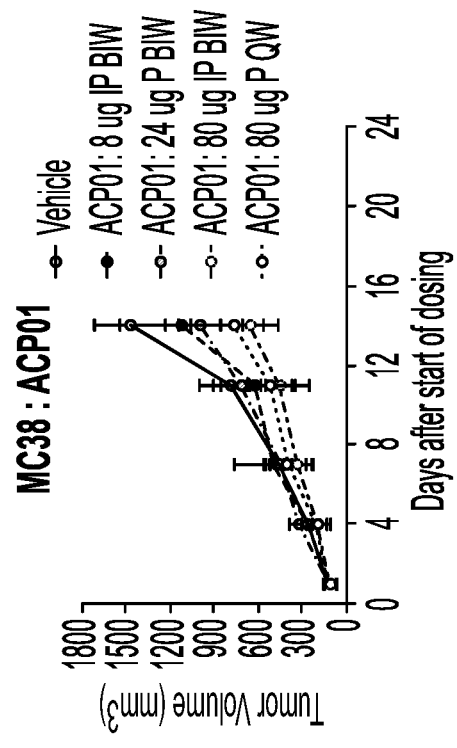
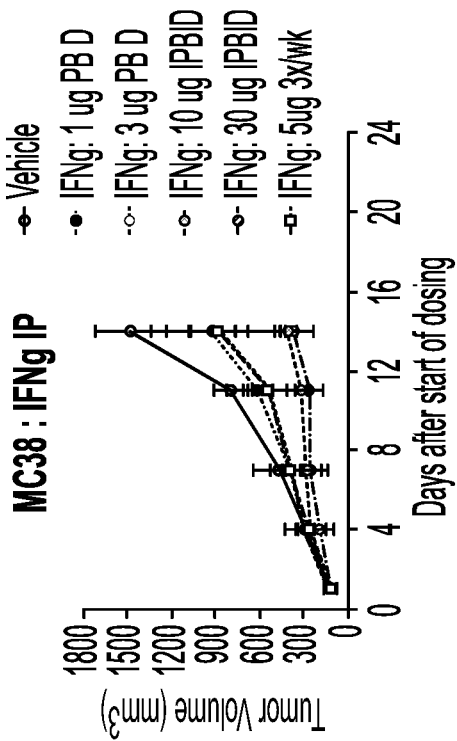
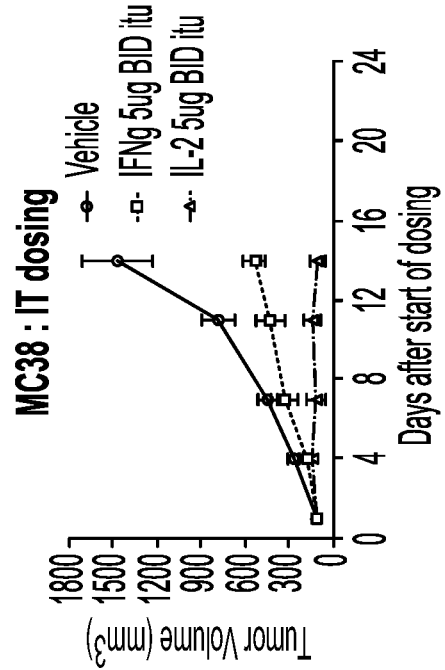
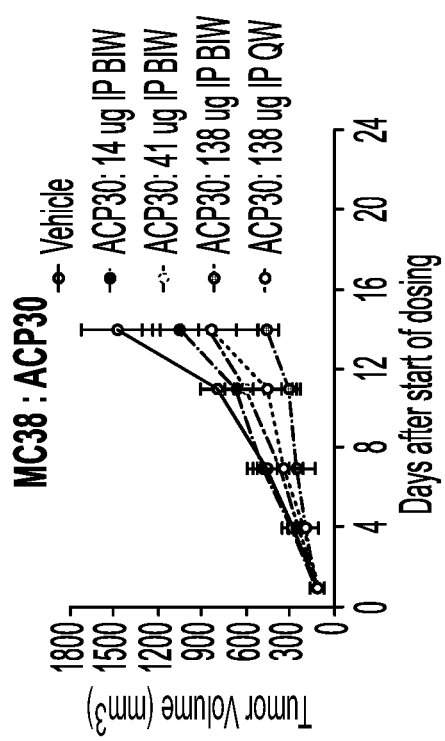

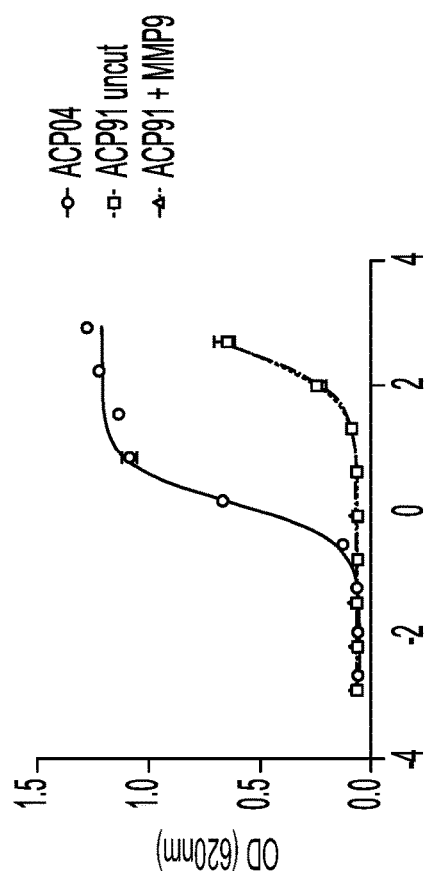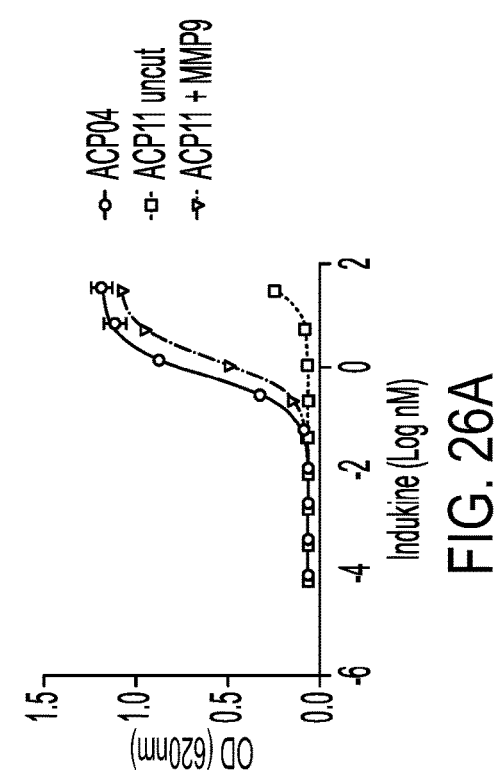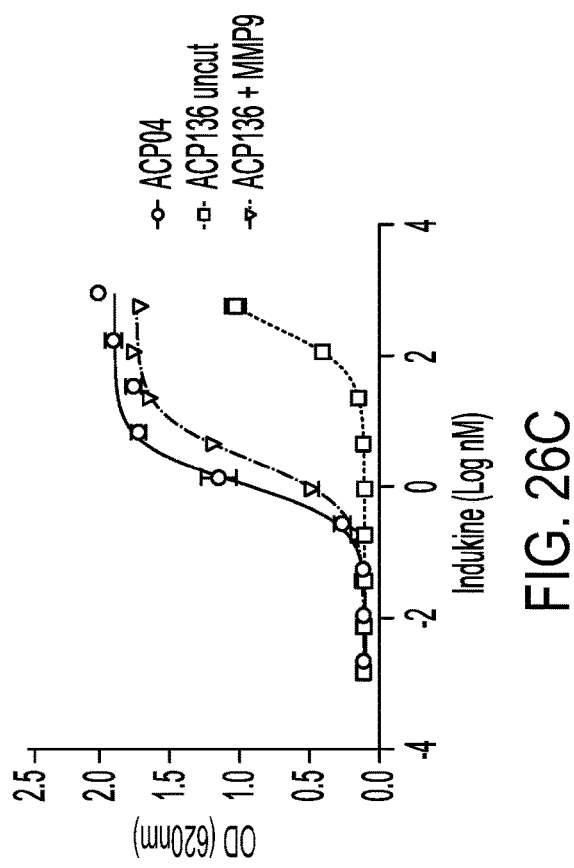
FIG. 26A
FIG. 26B
FIG. 26C

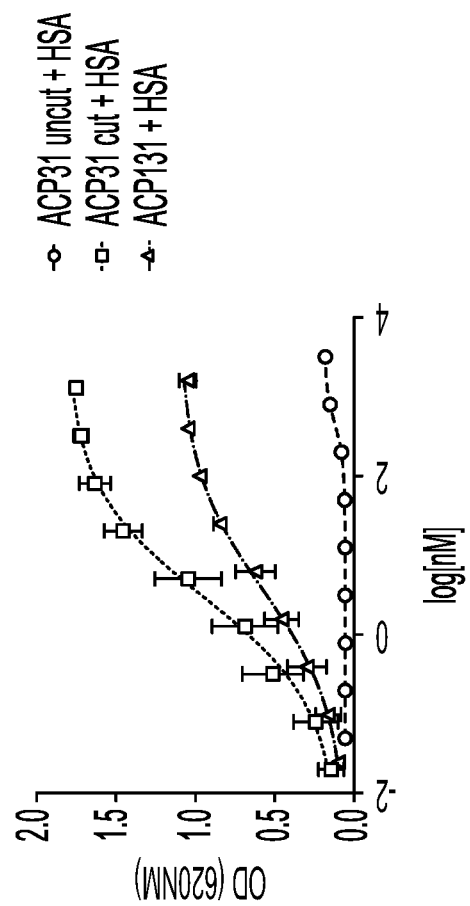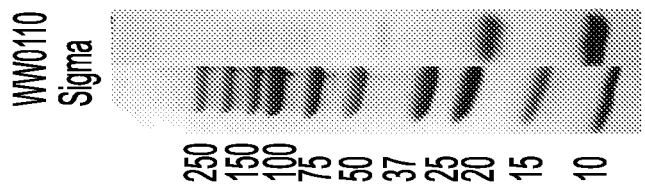
FIG. 27A

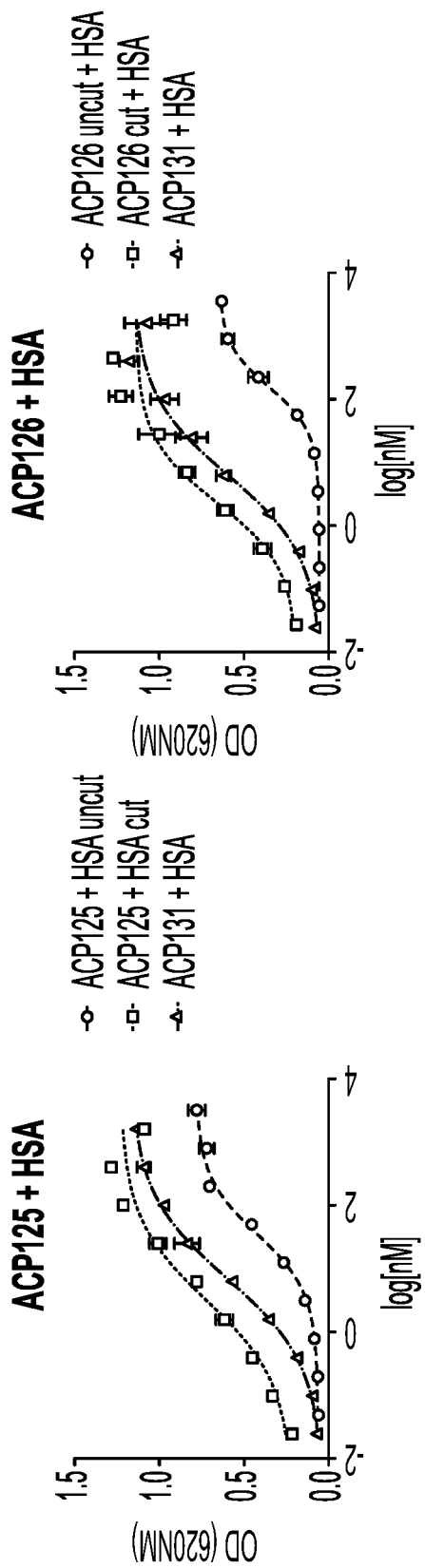

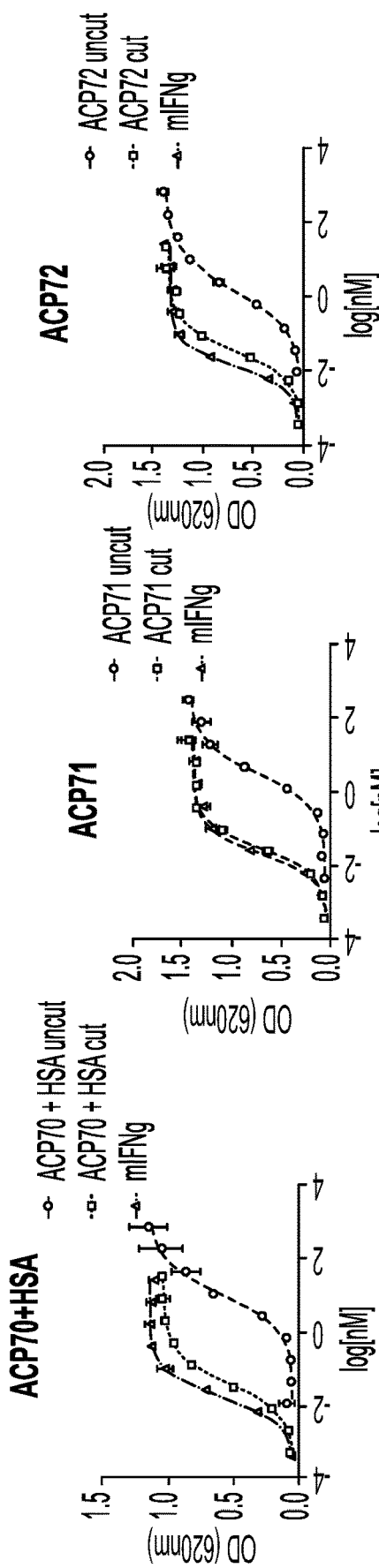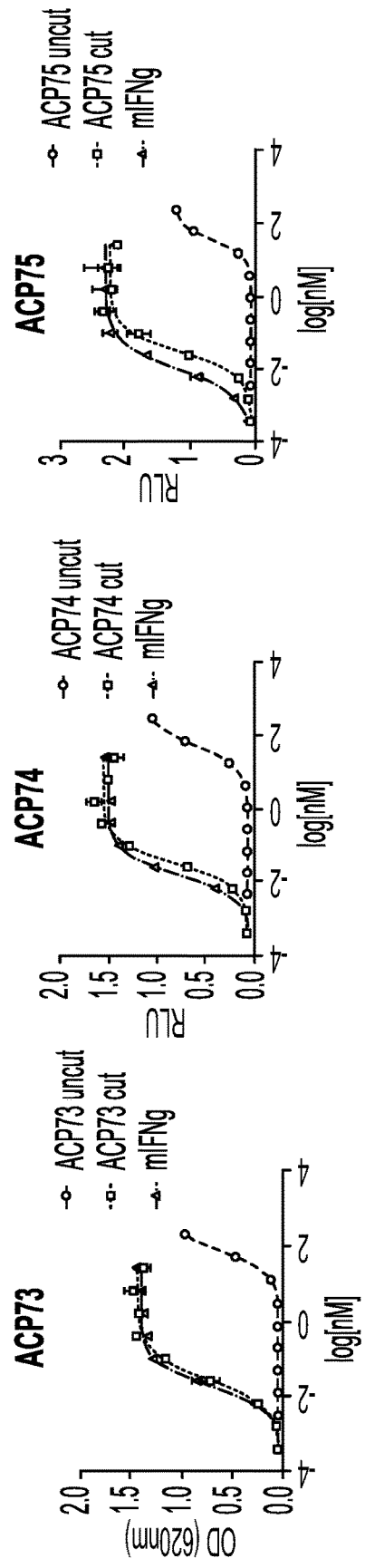

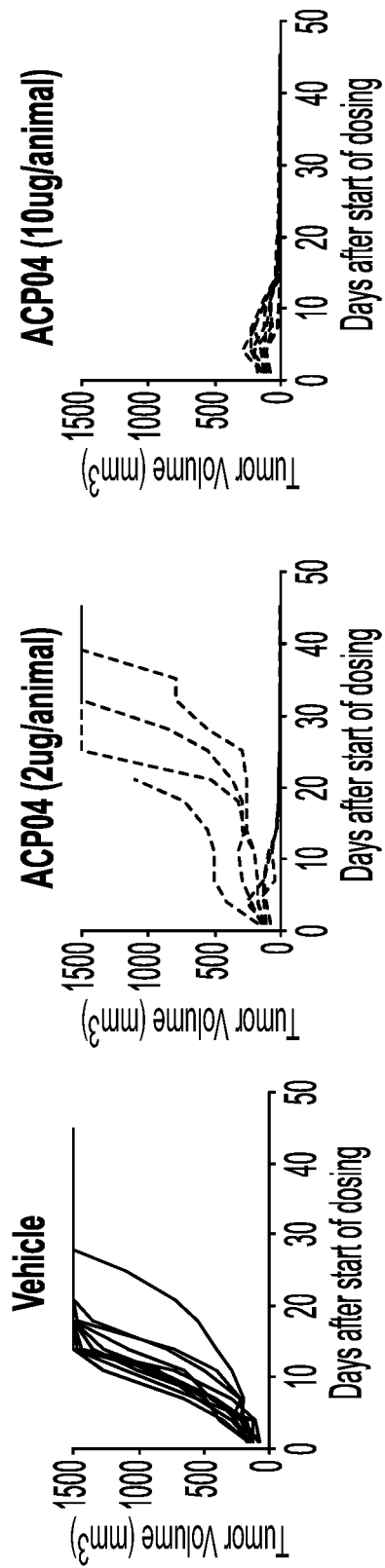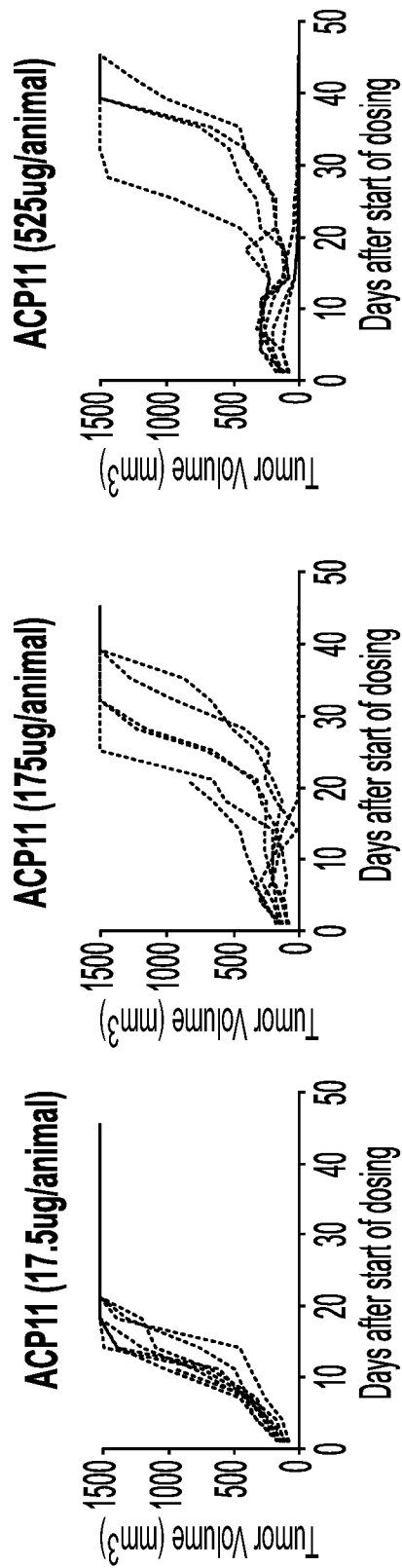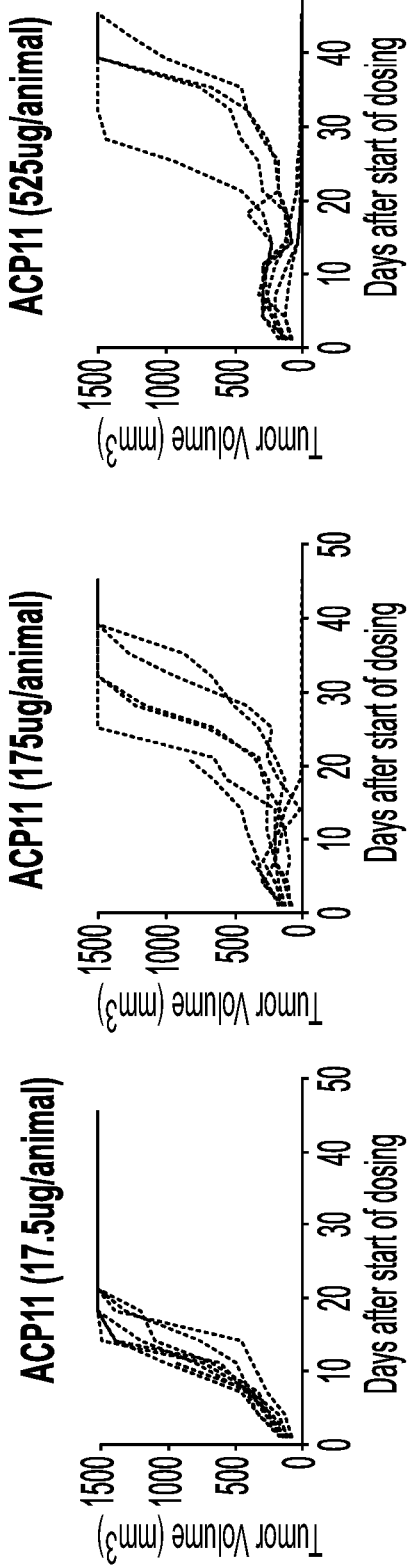
FIG. 30A  FIG. 30B  FIG. 30C  FIG. 30D  FIG. 30E  FIG. 30F

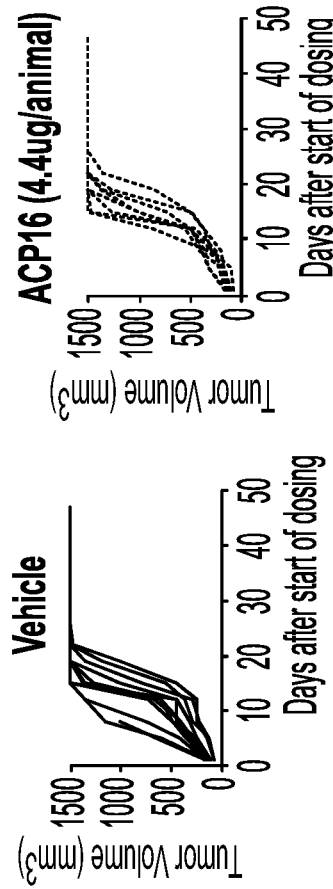
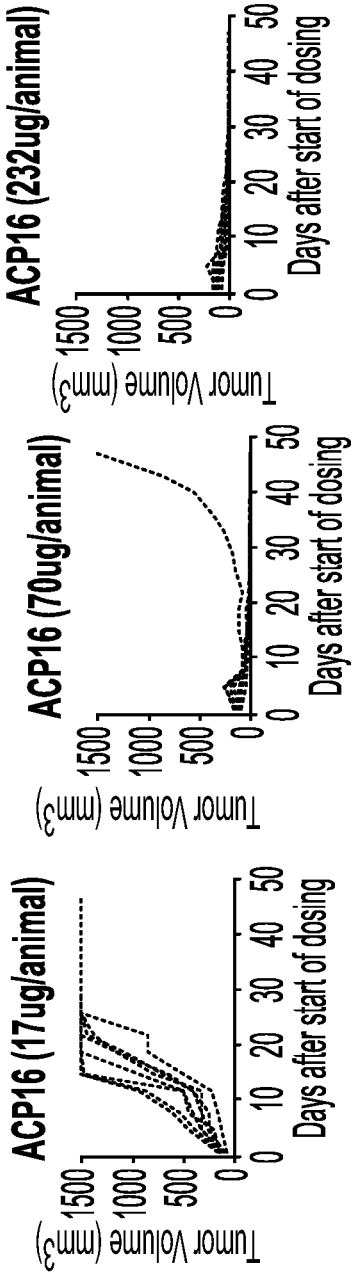
FIG. 32A, FIG. 32B, FIG. 32C, FIG. 32D, FIG. 32E

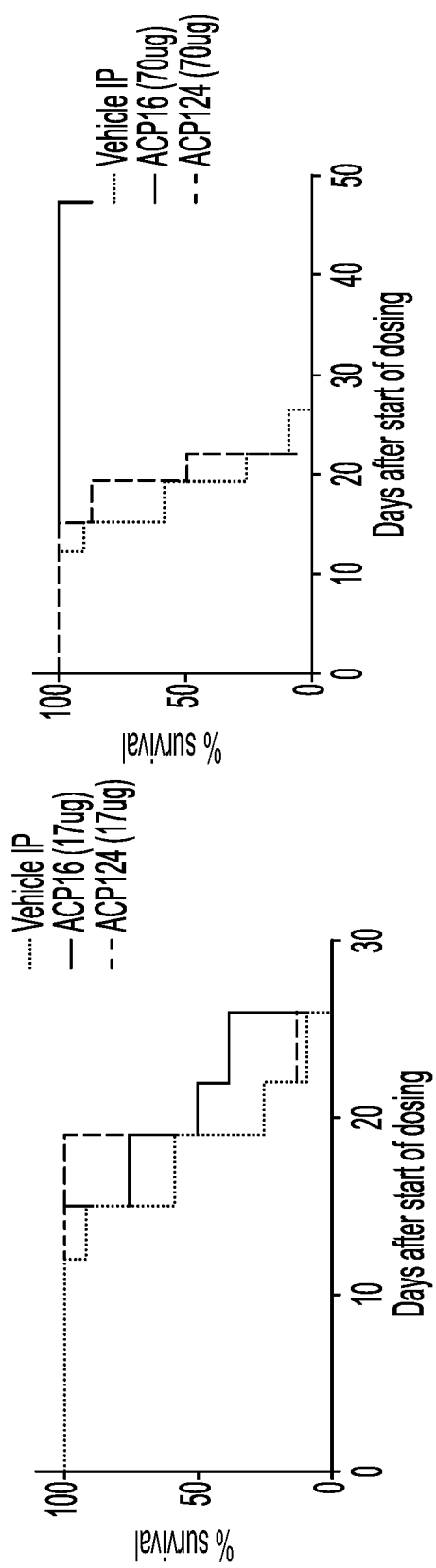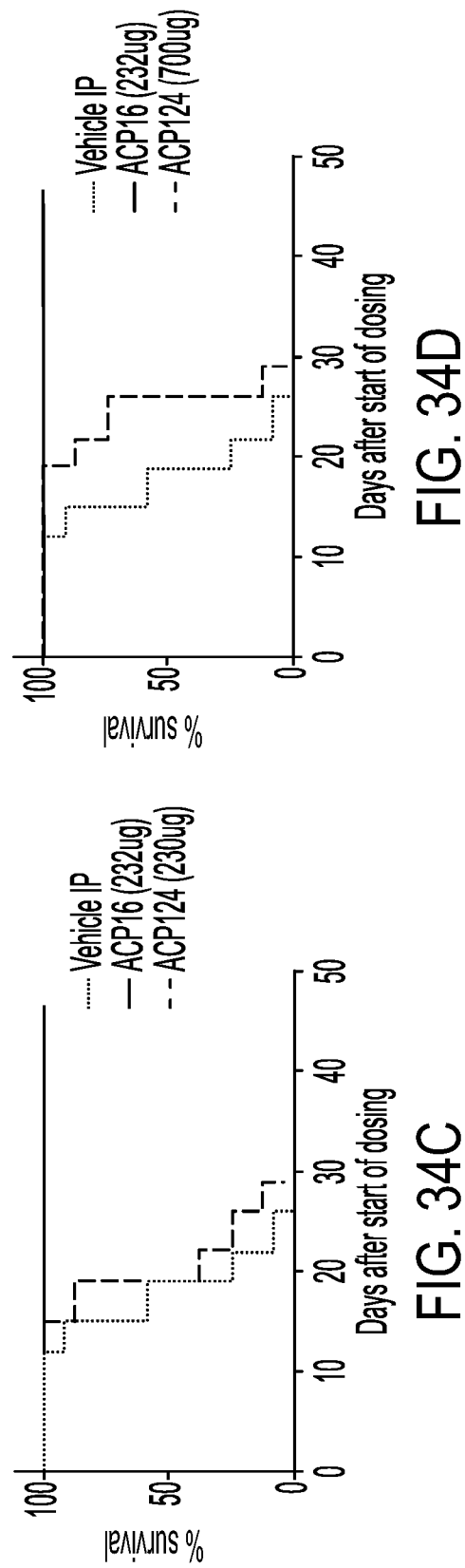
FIG. 34A
FIG. 34B
FIG. 34C
FIG. 34D

| Substrate & Sample | ADAM17_2 cond media | | CTSL1_1 cell lysate | | FAPa_1 cell lysate | | FAPa_1 cond media | | MMP9_1 cond media | | MMP14_1 cond media | |
|---|---|---|---|---|---|---|---|---|---|---|---|---|
| | Mean | SEM | Mean | SEM | Mean | SEM | Mean | SEM | Mean | SEM | Mean | SEM |
| Myofibroblasts | 0.00 | 0.00 | 13.65 | 0.61 | 0.58 | 0.05 | 0.00 | 0.00 | 0.00 | 0.00 | 0.21 | 0.11 |
| CT26 Parental | 0.26 | 0.02 | 9.63 | 0.64 | 1.22 | 0.11 | 1.42 | 0.24 | 0.21 | 0.01 | 1.10 | 0.05 |
| CT26-MMP9+ | 0.30 | 0.02 | 8.55 | 0.65 | 1.23 | 0.09 | 1.71 | 0.30 | 0.28 | 0.01 | 1.34 | 0.05 |
| YAMC | 0.52 | 0.03 | 5.29 | 0.05 | 0.45 | 0.06 | 2.27 | 0.32 | 0.34 | 0.01 | 1.19 | 0.10 |
| MC38 | 0.32 | 0.03 | 17.34 | 0.82 | 1.26 | 0.08 | 1.10 | 0.35 | 0.21 | 0.01 | 1.23 | 0.07 |

Western Blot probed with IL2 antibody

Western Blot probed with IL2 antibody

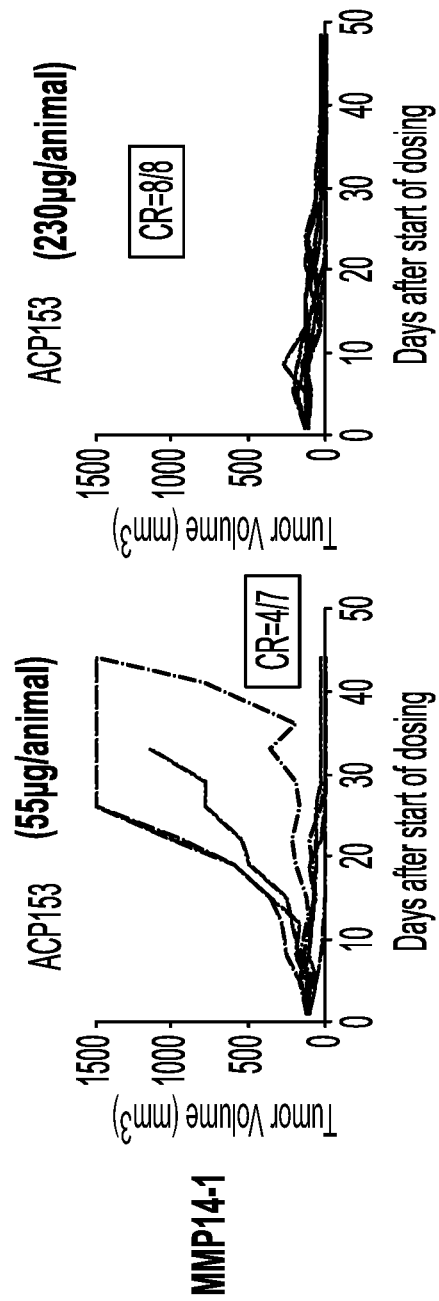
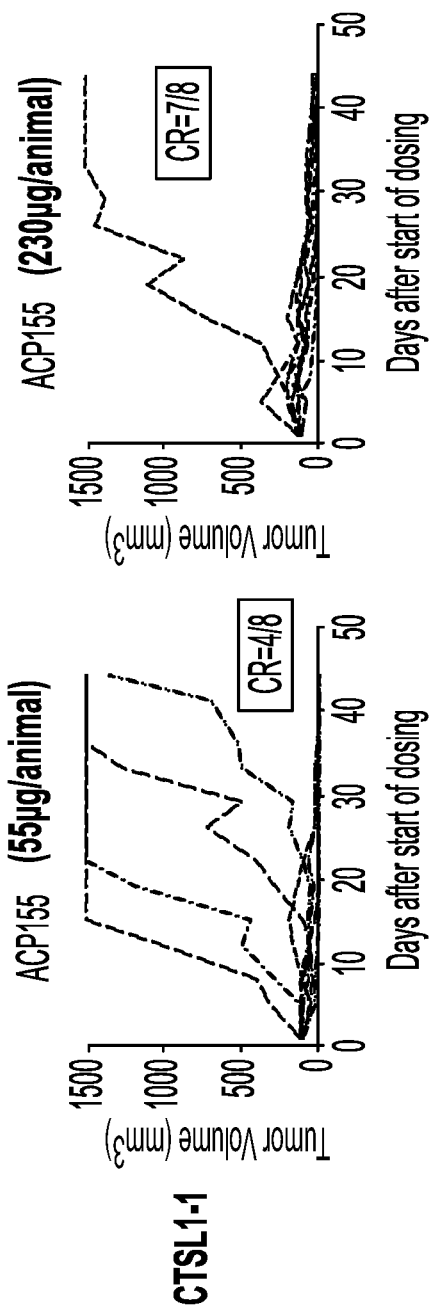
FIG. 58B
FIG. 58C

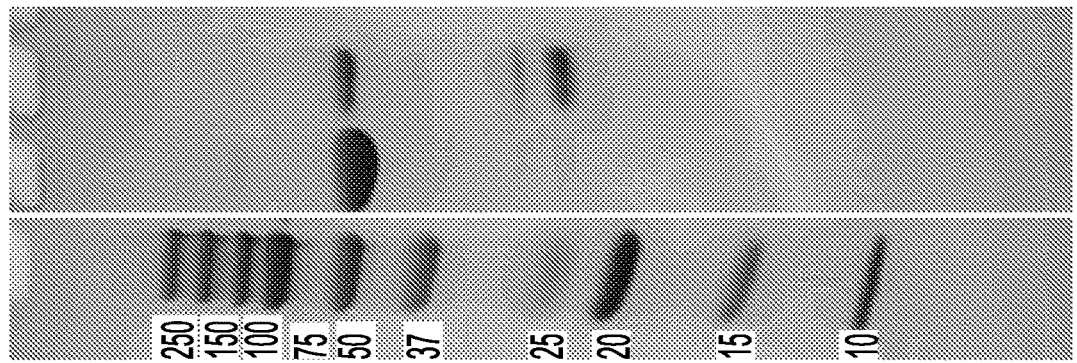
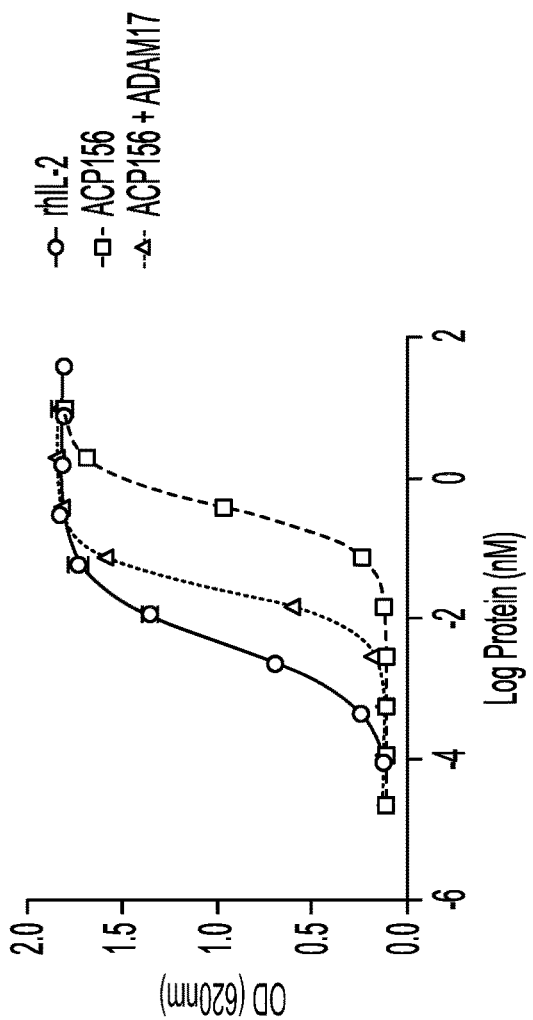
FIG. 61

| SUBSTRATE | | | | |
|---|---|---|---|---|
| NAME | SEQUENCE | motif #1 | motif #2 | motif #3 |
| ALU30-1 | gALFKSSFPsggGPALYAQggsgkggsgk | CTSL1_1 | MMP14_1 | - |
| ALU30-2 | rgsggGPAGLYAQgsggGPAGLYAQggsgk | MMP14_1 | MMP14_1 | - |
| ALU30-3 | kggGPAGLYAQGPAGLYAQGPAGLYAQgsr | MMP14_1 | MMP14_1 | MMP14_1 |
| ALU30-4 | rgGPAGLYAQgGPAGLYAQggGPAGLYAQk | MMP14_1 | MMP14_1 | MMP14_1 |
| ALU30-5 | kggALFKSSFPGGPAGIGPLAQKLKSSggs | CTSL1_1 | FAPa_1 | ADAM17_2 |
| ALU30-6 | sggPGGPAGIGALFKSSFPLAQKLKSSggg | FAPa_1 | CTSL1_1 | ADAM17_2 |
| ALU30-7 | rgPLAQKLKSSALFKSSFPGGPAGIGgggk | ADAM17_2 | CTSL1_1 | FAPa_1 |
| ALU30-8 | gggALFKSSFPLAQKLKSSPGGPAGIGggr | CTSL1_1 | ADAM17_2 | FAPa_1 |
| ALU30-9 | rgPGGPAGIGPLAQKLKSSALFKSSFPggg | FAPa_1 | ADAM17_2 | CTSL1_1 |
| ALU30-10 | rggPLAQKLKSSPGGPAGIGALFKSSFPgk | ADAM17_2 | FAPa_1 | CTSL1_1 |
| ALU30-11 | rsgGPAGLYAQALFKSSFPLAQKLKSSggg | MMP14_1 | CTSL1_1 | ADAM17_2 |
| ALU30-12 | ggPLAQKLKSSALFKSSFPGPAGLYAQggr | ADAM17_2 | CTSL1_1 | MMP14_1 |
| ALU30-13 | ggALFKSSFPGPAGLYAQPLAQKKLKSSggk | CTSL1_1 | MMP14_1 | ADAM17_2 |
| ALU30-14 | rggALFKSSFPLAQKLKSSGPAGLYAQggk | CTSL1_1 | ADAM17_2 | MMP14_1 |
| ALU30-15 | rggGPAGLYAQPLAQKLKSSALFKSSFpgg | MMP14_1 | ADAM17_2 | CTSL1_1 |
| ALU30-16 | sgPLAQKLKSSGPAGLYAQALFKSSFPgsk | ADAM17_2 | MMP14_1 | CTSL1_1 |
| ALU30-17 | kggPGGPAGIGPLAQRLRSSALFKSSFPgr | FAPa_1 | ADAM17_1 | CTSL1_1 |
| ALU30-18 | ksgPGGPAGIGALFFSSPPLAQKLKSSggr | FAPa_1 | CTSL1_2 | ADAM17_2 |
| ALU30-19 | sggFPRSGGSFNPRTFGSKRKRRGSRGggg | thrombin | factor Xa | hepsin |

FIG. 63A

| CLEAVAGE ENZYME | | | | | | | |
|---|---|---|---|---|---|---|---|
| MMP9 | MMP14 | FAPa | CTSL1 | ADAM17 | Factor Xa | Thrombin | Hepsin |
| +++ | ++ | + | +++++ | - | + | +++++ | - |
| +++ | + | ++++ | - | - | - | + | - |
| +++++ | ++ | ++++ | - | - | - | +++++ | - |
| +++++ | ++ | +++++ | - | - | - | +++ | - |
| - | - | ++++ | ++ | + | +++ | + | + |
| ++ | - | ++ | +++++ | ++ | + | +++ | + |
| + | - | - | +++++ | +++++ | + | + | + |
| - | - | - | ++ | ++++ | + | ++ | +++ |
| - | - | ++ | ++ | +++ | + | ++ | +++ |
| +++ | - | ++ | ++ | ++++ | + | ++ | + |
| + | ++++ | - | +++ | +++ | + | ++ | + |
| + | ++ | +++ | ++ | +++ | + | + | +++ |
| ++++ | ++ | ++ | ++ | ++++ | + | + | + |
| + | +++++ | - | +++ | +++ | + | ++ | +++ |
| ++++ | ++++ | +++ | + | ++ | + | + | +++ |
| +++ | +++++ | ++++ | ++ | ++++ | + | ++ | + |
| - | - | ++++ | +++++ | +++ | + | ++ | + |
| +++ | - | ++++ | ++++ | +++ | + | ++ | + |
| - | - | - | - | - | +++++ | ++++ | +++ |

FIG. 63B

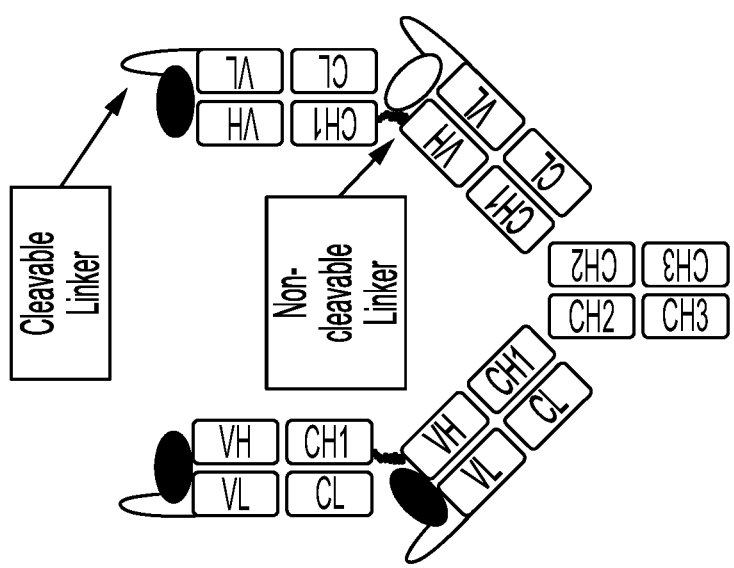
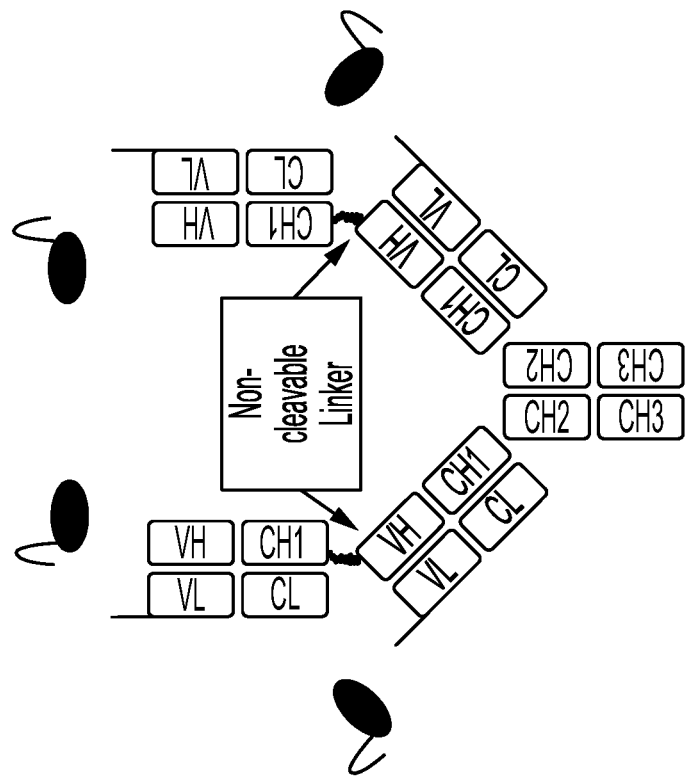
FIG. 64

//]: #

SEPARATION MOIETIES AND METHODS OF USE THEREOF

The present application is a continuation of U.S. patent application Ser. No. 17/082,955 filed on Oct. 28, 2020, which is a continuation of International Patent Application No. PCT/US2020/032988, filed on May 14, 2020, which designated the United States and claims the benefit of U.S. Provisional Application No. 62/847,914 filed on May 14, 2019, and U.S. Provisional Application No. 62/938,786 filed on Nov. 21, 2019, each of which are incorporated herein by reference in their entireties.

1. SEQUENCE LISTING

The instant application contains a Sequence Listing which has been submitted electronically in ASCII format and is hereby incorporated by reference in its entirety. Said ASCII copy, created on May 14, 2020, is named 761146_000140_SL.txt and is 896,815 bytes in size.

2. BACKGROUND

Recombinant fusion proteins containing two or more functional polypeptides have utility in many fields including, for use in protein purification, imaging, as therapeutics, and drug delivery. For example, protein drugs can be fused to Fc domains of antibodies or to carrier proteins (i.e., human serum albumin) for targeting, to extend their plasma half-lives and/or to achieve therapeutic effects. Chen et al., (2013), Adv Drug Deliv Rev. 65(10):1357-1369.

Direct fusion of functional polypeptide or domains without a linker may lead to many undesirable outcomes, including misfolding of the fusion proteins (Zhao et al., (2008), Protein Expr. Purif., 61:73-77), low yield in protein production (Amet et al., (2009), Pharm. Res. 26:523-528), or impaired bioactivity (Bai et al., (2006) Proc. Natl Acad. Sci. USA, 102:7292-7296). One approach to overcome these difficulties is to use linker sequences between the component polypeptides or domains in a fusion protein. However, the selection of a suitable linker to join protein domains together can be complicated and is often neglected in the design of fusion proteins. Chen et al., (2013), Adv Drug Deliv Rev. 65(10):1357-1369. The properties of linker sequences, such as length, hydrophobicity, amino acid composition, secondary structures, and the overall folding can affect linker suitability and need to be taken into consideration in designing and selecting an appropriate linker. In addition, linkers that can be cleaved under selected conditions or in selected biological locations (e.g., in tumor microenvironment) to deliver active therapeutic agents (e.g., therapeutic polypeptides) can provide targeted pharmacological activity of the therapeutic agents and reduce unwanted systemic effects. This introduces further complexity into designing suitable linkers.

There is a need for improved liner sequences that can be used to prepare stable fusion proteins, including linkers that can be cleaved under selected conditions. Accordingly, novel separation moieties or linkers are disclosed herein. The separation moieties or linkers disclosed herein can be utilized, for example to specifically deliver prodrugs such as conditionally active and/or targeted cytokines to target sites where the linkers are processed to activate bioactivity.

3. SUMMARY

Provided herein are compositions and methods to generate and use high efficiency separation moieties and/or linkers. The linkers can confer site-selectivity with regards to biological activity of the attached payload or payloads. In some embodiments, the separation moieties and/or linkers are used in conjugation with therapeutic proteins to treat a disease or disorder, such as proliferative disease, a tumorous disease, an inflammatory disease, an immunological disorder, an autoimmune disease, an infectious disease, a viral disease, an allergic reaction, a parasitic reaction, graft-versus-host disease and the like.

Disclosed herein are recombinant polypeptides comprising a separation moiety, wherein the separation moiety comprises an amino acid sequence is a substrate for an enzyme, specifically a protease. The protease can be selected from the group consisting of Fibroblast activation protein alpha (FAPa, also known as prolyl endopeptidase FAP), Cathepsin L (CTSL1), an ADAM selected from ADAM 8, ADAM 9, ADAM 10, ADAM12 ADAM17, and ADAMTS1, and an MMP selected from MMP1, MMP2, MMP9 or MMP14. The cleavable moiety can also be a substrate for a cathepsin, such as cathepsin B, cathepsin C, cathepsin D, cathepsin E, cathepsin G, cathepsin K and/or cathepsin L. Preferably, the cathepsin is Cathepsin L. Preferably, the protease is MMP14 or cathepsin L. The cleavable moiety can comprise an amino acid sequence that is a substrate for at least two proteases. In another embodiment, the separation moiety comprises two or more cleavable moieties, each of which is a substrate for a protease. The separation moiety can comprise a first cleavable moiety comprising a first amino acid sequence that is a substrate for a first protease and a second cleavable moiety comprising a second amino acid sequence that is a substrate for a second protease. In embodiments, the disclosure related to recombinant polypeptides that comprise a separation moiety that contains a protease cleavage motif as disclosed herein. The recombinant polypeptide can comprise a separation moiety that comprises an amino acid sequence selected from the group consisting of SEQ ID NOs: 195-220, or an amino acid sequence that has at least 90% identity to SEQ ID NOs: 195-220. Preferred separation moieties comprise the sequence GPAGLYAQ (SEQ ID NO: 195) or ALFKSSFP (SEQ ID NO: 198). The disclosure also relates to functional variants of separation moieties comprising SEQ IND NOs: 195-220. The functional variants of SEQ ID NO: 195 can comprise any of SEQ ID NOS: 258-331. The functional variants of SEQ ID NO: 198 can comprise of SEQ ID NO:198 comprises SEQ ID NOS: 199 or any of SEQ ID NOS: 332-408. The separation moieties disclosed herein can comprise Formula I: [D1]-[L1]-[D2]. D1 is a first domain of interest. L1 is a separation moiety that connects or links DI to D2, wherein the separation moiety comprises an amino acid sequence selected from SEQ ID NOs: 195-220 or an amino acid sequence that has at least about 90% identity to SEQ ID NOs:195-220. D2 is a second domain of interest.

In one embodiment, the recombinant polypeptide can further comprise a non-cleavable linker sequence. The recombinant polypeptide can include a therapeutic protein, such as a cytokine, chemokine, growth factor, soluble receptor, antigen-binding portion of an antibody (e.g., scFV, dAb) and the like. In another embodiment, the recombinant polypeptide comprises a cytokine, chemokine, growth factor, a soluble receptor, or any combination thereof. In another embodiment, the recombinant polypeptide comprises at least one of an extracellular domain, a transmembrane domain, and an intracellular domain. In one embodiment, the recombinant polypeptide comprises a cell surface receptor, a chimeric antigen receptor (CAR), or a T Cell Receptor (TCR) subunit. In one embodiment, the recombinant polypeptide comprises an antigen-binding polypeptide, an antibody or an antigen-binding portion thereof.

In one embodiment, the cleavable moiety is cleaved with either (a) greater catalytic efficiency or (b) greater specificity or (c) both (a) and (b), by one or more proteases than a reference polypeptide sequence. In another embodiment, the one or more proteases are selected from the group consisting of FAPa, CTSL1, an ADAM selected from ADAM 8, ADAM 9, ADAM 10, ADAM12 ADAM17, and ADAMTS1, and an MMP selected from MMP1, MMP2, MMP9 and MMP14. The one or more proteases can also include a protease selected from cathepsins, such as cathepsin B, cathepsin C, cathepsin D, cathepsin E, cathepsin G, cathepsin K and/or cathepsin L. In another embodiment, the reference polypeptide sequence is present in a naturally occurring polypeptide substrate for FAPa, CTSL1, an ADAM selected from ADAM 8, ADAM 9, ADAM 10, ADAM12 ADAM17, and ADAMTS1, and an MMP selected from MMP1, MMP2, MMP9 and MMP14, a cathepsin, such as cathepsin B, cathepsin C, cathepsin D, cathepsin E, cathepsin G, cathepsin K and/or cathepsin L or a combination thereof. In another embodiment, the cleavable moiety is cleaved with reduced catalytic efficiency by one or more proteases than a reference polypeptide sequence. In another embodiment the cleavable moiety is cleaved with reduced catalytic efficiency by one or more serum proteases. In another embodiment, the cleavable moiety is cleaved with reduced catalytic efficiency by one or more hepatic proteases. In another embodiment, the cleavable moiety is cleaved with reduced catalytic efficiency by one or more Factor Xa, hepsin, or thrombin.

In one embodiment, the recombinant polypeptide comprises two or more separation moieties. In one embodiment, the recombinant polypeptide is operably linked to a moiety selected from the group consisting of a polypeptide moiety, a lipid moiety, a nucleic acid moiety, a detectable moiety, and a small molecule.

Provided herein is a recombinant pro-protein comprising: a recombinant polypeptide comprising a cleavable moiety that is a substrate for a protease, wherein the cleavable moiety comprises an amino acid sequence selected from the group consisting of SEQ ID NOs: 195-220; and a polypeptide with biological activity, wherein the pro-protein has attenuated biological activity and wherein cleavage of the cleavable moiety by the protease produces a polypeptide with biological activity that is not attenuated. In one embodiment, the polypeptide with biological activity comprises a cytokine, chemokine, growth factor, a soluble receptor or a combination thereof. In some preferred aspects, the linkers are components of fusion proteins with therapeutic utility, and the linkers are not cleaved or are cleaved with low efficiency in the peripheral circulation but are cleaved with higher efficiency at a desired location in the body, such as a tumor microenvironment or site of inflammation. In another embodiment, the polypeptide with biological activity comprises at least one of an extracellular domain, a transmembrane domain, and an intracellular domain. In another embodiment, the polypeptide with biological activity comprises a cell surface receptor, a chimeric antigen receptor (CAR), or a T Cell Receptor (TCR) subunit. In another embodiment, the polypeptide with biological activity comprises an antigen-binding polypeptide, an antibody or an antigen-binding portion thereof.

The disclosure also relates to a fusion protein comprising: a. a signaling protein or molecule; and b. a blocking moiety selected from a steric blocking moiety, a specific blocking moiety, and the combination thereof; and c. a peptide linker that comprises a cleavable moiety, e.g., a cleavable moiety disclosed herein, having at least one protease-cleavable sequence. In one embodiment, the fusion protein, wherein (a) and (b) are operably linked by (c). In another embodiment, the fusion protein, wherein the peptide linker comprises two or more copies of the same cleavable moiety. In another embodiment, the fusion protein wherein the steric blocking moiety comprises human serum albumin (HSA) or an anti-HSA antibody. In another embodiment, the fusion protein wherein the signaling protein is an interleukin-2 amino acid sequence comprising: (i) a non-native N terminus and/or (ii) a non-native C terminus. In another embodiment, the fusion protein wherein the signaling protein is an interleukin-2 amino acid sequence. In another embodiment, the fusion protein further comprising one or more half-life extension domains that are not also a specific blocker. In another embodiment, the fusion protein wherein the non-native N and/or C termini are generated by circular permutation.

The fusion polypeptide provided herein can a first polypeptide fusion partner linked to a ligand by a protease cleavable linker, wherein the cleavable linker has been optimized for catalytic efficiency, and wherein the ligand has been optionally modified, wherein the first polypeptide fusion partner is a blocking moiety which prevents binding of the modified ligand to a target receptor or a subunit of a target receptor until cleavage of the protease cleavable linker.

The fusion polypeptide provided herein can also a fusion polypeptide comprising a first polypeptide fusion partner linked to a ligand by a protease cleavable linker, wherein the cleavable linker has been optimized for catalytic efficiency, and wherein the ligand has been optionally modified, including by circularly permutation to create a non-native N-terminus and a new C-terminus as compared to a native ligand, and wherein at least one of the new N-terminus or the new C-terminus of the modified ligand is operably linked to a first polypeptide fusion partner to form a fusion polypeptide wherein the first polypeptide fusion partner is a blocking moiety which prevents binding of the modified ligand to a target receptor or a subunit of a target receptor until cleavage of the protease cleavable linker.

In one embodiment, the first polypeptide fusion partner is selected from the group consisting of an antibody, an antibody fragment, and an albumin molecule. In another embodiment, the first polypeptide fusion partner further comprising a second polypeptide fusion partner comprising a second blocking moiety. In another embodiment, the second polypeptide fusion partner is a different kind of blocking moiety than the first polypeptide fusion partner. In another embodiment, the first polypeptide fusion partner is albumin and the second polypeptide fusion partner is a domain comprising a complementary amino acid sequence that blocks activity of the cytokine. In another embodiment, the first polypeptide fusion partner is a steric blocker, such as albumin, and the second polypeptide is a specific blocker, such as a cytokine receptor, portion of a cytokine receptor, a de novo affinity peptide specific for the cytokine, or an antibody or antibody fragment that specifically binds the cytokine of the fusion polypeptide. In another embodiment, the second polypeptide fusion partner is the same kind of blocking moiety as the first polypeptide fusion partner.

In one embodiment, the fusion protein further comprises a tumor antigen binding component. In another embodiment, the fusion protein further comprises a serum half-life extension domain. In another embodiment, the ligand is selected from the group consisting of helix bundle proteins and cytokines (including, but not limited to, growth hormone, IL-2, IL-4, IL-5, IL-6, IL-10, IL-22, IL-23p19, IL-11, IL-13, IL-15, IL-12p35, IL-21, IL-30 (IL27p28), IL-34, IL-35, IL-35p35, IFN-α, IFN-β, IFNγ, LIF, CNTF, oncostatin M, CLCF-1, GCSF, GM-CSF, EPO, ferritin, leptin, placental lactogen, prolactin, apolipoprotein e), b-trefoil proteins (including, but not limited to, IL-1α, IL-1β, IL-1Ra, IL18, IL-33, IL-36Ra, IL-36a, IL-36b, IL-36g, IL-37, IL-38, IL1Hy2, FGF-1, FGF-2, FGF-3, FGF-4, FGF-5, FGF-6, FGF-7, FGF-8a, FGF-8b, FGF-8e, FGF-8f, FGF-9, FGF-10, FGF-11, FGF-12, FGF-13, FGF-14, FGF-16, FGF-17, FGF-18, FGF-19, FGF-20, FGF-21, FGF-22, FGF-23), α/β (TIM) barrel proteins (including, but not limited to, triosephosphate isomerase), beta sandwich proteins (including, but not limited to, galectin-1, galectin-3, TNF-beta, seven β-propeller proteins, class 1 MHC α1α2 domain, integrin I domain, GYF domain, C1 domain, C2 domain (for example, from cPLA2, PKC, synaptotagmin), PDZ domains, C3d, C5a. In one embodiment, wherein the ligand comprises IL-2 polypeptide or a fragment or fragments thereof. In another embodiment, the protease-cleavable linker polypeptide comprises a sequence that is capable of being cleaved by at least one protease selected from the group consisting of a kallikrein, thrombin, chymase, carboxypeptidase A, cathepsin G, an elastase, a FAP, an ADAM selected from ADAM 8, ADAM 9, ADAM 10, ADAM12 ADAM17, and ADAMTS1, PR-3, granzyme M, a calpain, a matrix metalloproteinase (MMP), a plasminogen activator, a cathepsin, a caspase, a tryptase, and a tumor cell surface protease. In another embodiment, the cytokine or fragment or mutein thereof is substantially dissociated from the cytokine blocking moiety after the protease-cleavable polypeptide linker is cleaved by a protease.

Disclosed herein are fusion polypeptide comprising at least one of each of: a cytokine polypeptide or functional fragment or mutein thereof [A]; a cytokine blocking moiety [B]; and an optimized protease-cleavable polypeptide linker [L]; wherein the blocking moiety is selected from the group consisting of an antibody, an antibody fragment, and an albumin, and wherein the cytokine comprises a circularly permuted cytokine. In some embodiments, the fusion protein further comprises a tumor antigen binding component and/or a serum half-life extension domain. In some embodiment, the fusion polypeptide wherein the cytokine peptide or functional fragment or mutein thereof is selected from the group consisting of helix bundle proteins and cytokines (including, but not limited to, growth hormone, IL-2, IL-4, IL-5, IL-6, IL-10, IL-22, IL-23p19, IL-11, IL-13, IL-15, IL-12p35, IL-21, IL-30 (IL27p28), IL-34, IL-35, IL-35p35, IFN-β, IFNγ, LIF, CNTF, oncostatin M, CLCF-1, GCSF, GM-CSF, EPO, ferritin, leptin, placental lactogen, prolactin, apolipoprotein e), a FAP (e.g., Fapα), an ADAM selected from ADAM 8, ADAM 9, ADAM 10, ADAM12 ADAM17, and ADAMTS1, b-trefoil proteins (including, but not limited to, IL-1α, IL-113, IL-1Ra, IL18, IL-33, IL-36Ra, IL-36a, IL-36b, IL-36g, IL-37, IL-38, IL1Hy2, FGF-1, FGF-2, FGF-3, FGF-4, FGF-5, FGF-6, FGF-7, FGF-8a, FGF-8b, FGF-8e, FGF-8f, FGF-9, FGF-10, FGF-11, FGF-12, FGF-13, FGF-14, FGF-16, FGF-17, FGF-18, FGF-19, FGF-20, FGF-21, FGF-22, FGF-23), α/β (TIM) barrel proteins (including, but not limited to, triosephosphate isomerase), beta sandwich proteins (including, but not limited to, galectin-1, galectin-3, TNF-β, seven β-propeller proteins, class 1 MHC α1α2 domain, integrin I domain, GYF domain, Cl domain, C2 domain (for example, from cPLA2, PKC, synaptotagmin), PDZ domains, C3d, C5a. In one embodiment, the cytokine peptide or functional fragment or mutein thereof comprises IL-2. In another embodiment, the cytokine blocking moiety comprises a ligand binding domain or fragment or mutein of a cognate receptor for the cytokine, a single domain antibody or scFv that binds the cytokine polypeptide or functional fragment or mutein thereof, or an antibody or antibody fragment that binds a receptor of the cytokine. In another embodiment, antibody is a single domain antibody or scFv. In another embodiment, the blocking moiety extends the serum half-life of the cytokine or fragment thereof.

Disclosed herein are fusion polypeptides comprising a protease cleavable moiety, wherein the sequence is catalytically optimized for cleavage by certain proteases and wherein protease cleavage renders the composition inducible in a tumor microenvironment. In one embodiment, the fusion protein further comprises a biologically inactive polypeptide, wherein cleavage of the cleavable moiety by the protease converts the biologically inactive polypeptide to a biologically active polypeptide. In one embodiment, the biologically inactive polypeptide comprises a cytokine, chemokine, growth factor, or soluble receptor. In another embodiment, the biologically inactive polypeptide comprises at least one of an extracellular domain, a transmembrane domain, and an intracellular domain. In another embodiment, the biologically inactive polypeptide comprises a cell surface receptor, a chimeric antigen receptor (CAR), or a T Cell Receptor (TCR) subunit. In another embodiment, the biologically inactive polypeptide comprises an antigen-binding polypeptide, an antibody or an antigen-binding portion thereof.

The disclosure further relates to a nucleic acid encoding any of the polypeptides disclosed herein, a vector comprising any of the nucleic acids encoding any of the polypeptides disclosed herein, and a host cell comprising said vector.

Methods of making a pharmaceutical composition, comprising culturing the host cell comprising a vector comprising a nucleic acid encoding any of the polypeptides disclosed herein, under suitable conditions for expression and collection of desired polypeptides are provided herein. Method of using any of the polypeptides disclosed herein comprising administering an effective amount of a pharmaceutical composition comprising such polypeptides to a subject in need thereof are described. For example, use for treating a subject with a disease or disorder disclosed herein.

Provided herein are pharmaceutical compositions comprising an effective amount of any of the recombinant polypeptides, any of the pro-proteins, any of the fusion proteins, any of the fusion polypeptides, any of the nucleic acids, any of the vectors, or any of the host cells comprising such vectors disclosed herein. For example, a pharmaceutical composition for treating a subject with a disease or disorder disclosed herein.

Also disclosed is the use of the recombinant polypeptides, pro-proteins, fusion proteins, fusion polypeptides, nucleic acids, vectors, or host cells comprising such vectors disclosed herein for the manufacture of a medicament for treating a disease or disorder disclosed herein.

4. BRIEF DESCRIPTION OF THE DRAWINGS

FIG. 1A is a schematic illustrating a protease-activated cytokine or chemokine that includes a blocking moiety. The blocking moiety may optionally function as a serum half-life extending domain. To the left of the arrow the drawing shows that a cytokine is connected to a blocking moiety via a protease-cleavable linker, thus blocking its ability to bind to its receptor. To the right of the arrow the drawing shows that in an inflammatory or tumor environment a protease cleaves at a protease-cleavage site on the linker, releasing the blocking moiety and allowing the cytokine to bind to its receptor.

FIG. 1B is a schematic illustrating a protease-activated cytokine or chemokine wherein HSA (blocking moiety) is directly bound to the cytokine or chemokine of interest, with a protease cleavage site between the HSA and a cytokine or chemokine of interest. To the left of the arrow the drawing shows that a cytokine is connected to a blocking moiety via a protease-cleavable linker, thus blocking its ability to bind to its receptor. To the right of the arrow the drawing shows that in an inflammatory or tumor environment, the protease cleaves at a protease-cleavage site on linker, releasing the blocking moiety and allowing the cytokine to bind to its receptor.

FIG. 1C is a schematic illustrating a protease-activated cytokine or chemokine wherein more than one HSA (blocking moiety) is bound directly to the molecule of interest. If desired, one or more of the HSA can be bonded to the cytokine or chemokine through a linker, such as a linker that contains a protease cleavage site. To the left of the arrow the drawing shows that a cytokine is connected to a blocking moiety via a protease-cleavable linker, thus blocking its ability to bind to its receptor. To the right of the arrow the drawing shows that in an inflammatory or tumor environment, protease cleaves at protease-cleavage site on linker, releasing the blocking moiety and allowing cytokine to bind receptor. The cytokine now has similar pK properties as compared to the native cytokine (e.g., has a short half-life).

FIG. 1D is a schematic illustrating a protease-activated cytokine or chemokine comprising more than one cytokine, of the same type or different type, each of which is bonded to a binding domain through a protease-cleavable linker. To the left of the arrow the drawing shows that a cytokine is connected to a blocking moiety via a protease-cleavable linker, thus blocking its ability to bind to its receptor. To the right of the arrow the drawing shows that in an inflammatory or tumor environment a protease cleaves at a protease cleavage site on linker, releasing the blocking moiety and allowing the cytokine to bind to its receptor.

FIG. 2 is a schematic illustrating a protease-activated cytokine or chemokine comprising a cytokine or chemokine polypeptide, a blocking moiety, and a serum half-life extending domain connected by at least one protease-cleavable linker. To the left of the arrow the drawing shows that a cytokine is connected to a blocking moiety via protease-cleavable linkers, thus blocking its ability to bind to its receptor. It is also bound to a separate half-life extension element, which extends half-life in serum. To the right of the arrow the drawing shows that in an inflammatory or tumor environment a protease cleaves at a protease-cleavage site on linker, thus releasing the serum half-life extension element and the blocking moiety and allowing the cytokine to bind to its receptor. The cytokine now has similar pK properties as compared to the native cytokine (e.g., a short half-life).

FIG. 3 is a schematic illustrating a protease-activated cytokine or chemokine comprising a cytokine or chemokine polypeptide, a blocking moiety, and a targeting domain connected by at least one protease-cleavable linker. To the left of the arrow the drawing shows that a cytokine is connected to a blocking moiety and a targeting domain via a protease-cleavable linker, thus blocking its ability to bind to its receptor. To the right of the arrow the drawing shows that in an inflammatory or tumor microenvironment a protease cleaves at the protease cleavage site in the linker, releasing the targeting domain and the blocking moiety and allowing the cytokine to bind to its receptor.

FIG. 4A is a schematic illustrating a protease-activated cytokine or chemokine comprising a cytokine or chemokine polypeptide, a blocking moiety, a targeting domain, and a serum half-life extending domain connected by at least one protease-cleavable linker, wherein the cytokine polypeptide and the targeting domain are connected by a protease-cleavable linker. To the left of the arrow, the drawing shows that a cytokine or chemokine is connected to targeting domain, blocking moiety, and half-life extension element via protease-cleavable linker(s), thus blocking its ability to bind to its receptor. To the right of the arrow the drawing shows that in an inflammatory or tumor environment, the protease cleaves at a protease-cleavage site on linker(s), releasing the half-life extension element, the targeting domain, and the blocking moiety, and allowing the cytokine to bind to its receptor. The cytokine now has similar pK properties as compared to the native cytokine (e.g., short half-life).

FIG. 4B is a schematic illustrating a protease-activated cytokine or chemokine comprising a cytokine or chemokine polypeptide, a blocking moiety, a targeting domain, and a serum half-life extending domain connected by at least one protease-cleavable linker. To the left of the arrow, the drawing shows that a cytokine is connected to targeting domain, a blocking moiety, and a half-life extension element via protease-cleavable linker(s), thus blocking its ability to bind to its receptor. To the right of the arrow the drawing shows that in an inflammatory or tumor environment, the protease cleaves at a protease-cleavage site on linker(s), releasing the half-life extension element and the blocking moiety and allowing the cytokine to bind to the receptor. The targeting moiety remains bound, keeping the cytokine in the tumor microenvironment. The cytokine now has similar pK properties as compared to the native cytokine (e.g., a short half-life).

FIG. 5 depicts a graph showing that Linkers-2 (GPAGLYAQ, SEQ ID NO: 195) and Linkers-3 (ALFKSSFP, SEQ ID NO: 198) are minimally cleaved in lung, kidney, and liver cells.

FIGS. 6A-6B show graphs that polypeptides containing recombinant human IL-2 and the sequence for Linker-1 (GPAGMKGL, SEQ ID NO: 196), Linker-2 (GPAGLYAQ, SEQ ID NO: 195), or Linker-3 (ALFKSSFP, SEQ ID NO: 198) are not processed by healthy lung fibroblasts.

FIGS. 7A-7H is a series of graphs showing activity of exemplary IL-2 fusion proteins in IL-2 dependent cytotoxic T lymphocyte cell line CTLL-2. Each graph shows results of the IL-2 proliferation assay as quantified by CellTiter-Glo® (Promega) luminescence-based cell viability assay. Each proliferation assay was performed with HSA (FIGS. 7B, 7D, 7F, 7H) or without (FIGS. 7A, 7C, 7E, 7G). Each fusion protein comprises an anti-HSA binder, and both uncleaved and MMP9 protease cleaved versions of the fusion protein were used in each assay.

FIGS. 8A-8F is a series of graphs showing activity of exemplary IL-2 fusion proteins in IL-2 dependent cytotoxic T lymphocyte cell line CTLL-2. Each graph shows results of the IL-2 proliferation assay as quantified by CellTiter-Glo (Promega) luminescence-based cell viability assay. Both uncleaved and MMP9 protease cleaved versions of the fusion protein were used in each assay.

FIGS. 9A-9Z is a series of graphs showing activity of exemplary IL-2 fusion proteins in IL-2 dependent cytotoxic T lymphocyte cell line CTLL-2. Each graph shows results of the IL-2 proliferation assay as quantified by CellTiter-Glo (Promega) luminescence-based cell viability assay. Both uncleaved and MMP9 protease cleaved versions of the fusion protein were used in each assay.

FIG. 10 shows results of protein cleavage assay. Fusion protein ACP16 was run on an SDS-PAGE gel in both cleaved and uncleaved form. As can be seen in the gel, cleavage was complete.

FIGS. 11A-11B are a series of graphs depicting results from a HEK-Blue IL-12 reporter assay performed on human p40/murine p35 IL12 fusion proteins and recombinant human IL12 (Rec hIL-12). Analysis was performed based on quantification of Secreted Alkaline Phosphatase (SEAP) activity using the reagent QUANTI-Blue® (InvivoGen). Results confirm that IL12 protein fusion proteins are active.

FIGS. 12A-12F show a series of graphs depicting the results of HEK-blue assay of four IL-12 fusion proteins, before and after cleavage by MMP9. Analysis was performed based on quantification of Secreted Alkaline Phosphatase (SEAP) activity using the reagent QUANTI-Blue (InvivoGen). The data show greater activity in the cleaved IL12 than in the full fusion protein. Constructs tested were ACP06 (FIG. 12A), ACP07 (FIG. 12C), ACP08 (FIG. 12B), ACP09 (FIG. 12D), ACP10 (FIG. 12E), ACP11 (FIG. 12F)

FIG. 13 shows results of protein cleavage assay. Fusion protein ACP 11 was run on an SDS-PAGE gel in both cleaved and uncleaved form. As can be seen in the gel, cleavage was complete.

FIG. 14 is a schematic which depicts a non-limiting example of an inducible cytokine protein, wherein the construct is activated upon protease cleavage of a linker attached between two subunits of the cytokine.

FIGS. 15A-15D are graphs depicting results from a HEK-Blue assay performed on human p40/murine p35 IL12 fusion proteins and recombinant human IL12 (Rec hIL-12). Results confirm that IL12 protein fusion proteins are active. Each proliferation assay was performed with HSA or without HSA.

FIGS. 16A-16F are a series of graphs showing activity of exemplary IFNγ fusion proteins compared to activity of mouse IFNγ control using WEHI 279 cell survival assay. Each assay was performed with medium containing HSA (+HSA) or not containing HSA (-HSA). Each fusion protein comprises an anti-HSA binder, and both uncleaved and MMP9 protease cleaved versions of the fusion protein were used in each assay.

FIGS. 17A-17F are a series of graphs showing activity of exemplary IFNγ fusion proteins compared to activity of mouse IFNγ control using B16 reporter assay. Each assay was performed with medium containing HSA (+HSA) or not containing HSA (-HSA). Each fusion protein comprises an anti-HSA binder, and both uncleaved and MMP9 protease cleaved versions of the fusion protein were used in each assay.

FIGS. 18A-18B shows results of protein cleavage assay. Two constructs, ACP31 (IFN-a fusion protein; FIG. 18A) and ACP55 (IFN-γ fusion protein; FIG. 18B), were run on an SDS-PAGE gel in both cleaved and uncleaved form. As can be seen in the gel, cleavage was complete.

FIGS. 19A-19B are a series of graphs showing activity of exemplary IFNγ fusion proteins compared to activity of mouse IFNγ control using B16 reporter assay. Each assay was performed with culture medium containing HSA, and each fusion protein comprises an anti-HSA binder. Both uncleaved and MMP9 protease cleaved versions of the fusion protein were used in each assay.

FIGS. 20A-20B are a series of graphs showing activity of exemplary IFNα fusion proteins compared to activity of mouse IFNalphaA control using a B16 reporter assay. Each assay was performed with medium containing HSA, and each fusion protein comprises an anti-HSA binder. Both uncleaved and MMP9 protease cleaved versions of the fusion protein were used in each assay.

FIGS. 21A-21D are a series of graphs depicting the results of tumor growth studies using the MC38 cell line. FIG. 21A-21C show the effect of IFNγ and IFNγ fusion proteins on tumor growth when injected intraperitoneally (IP) using different dosing levels and schedules (μg=micrograms, BID=twice daily, BIW=twice weekly, QW=weekly). FIG. 21D shows the effect of intratumoral (IT) injection of IFNγ and IL-2 on tumor growth.

Figure 24A:
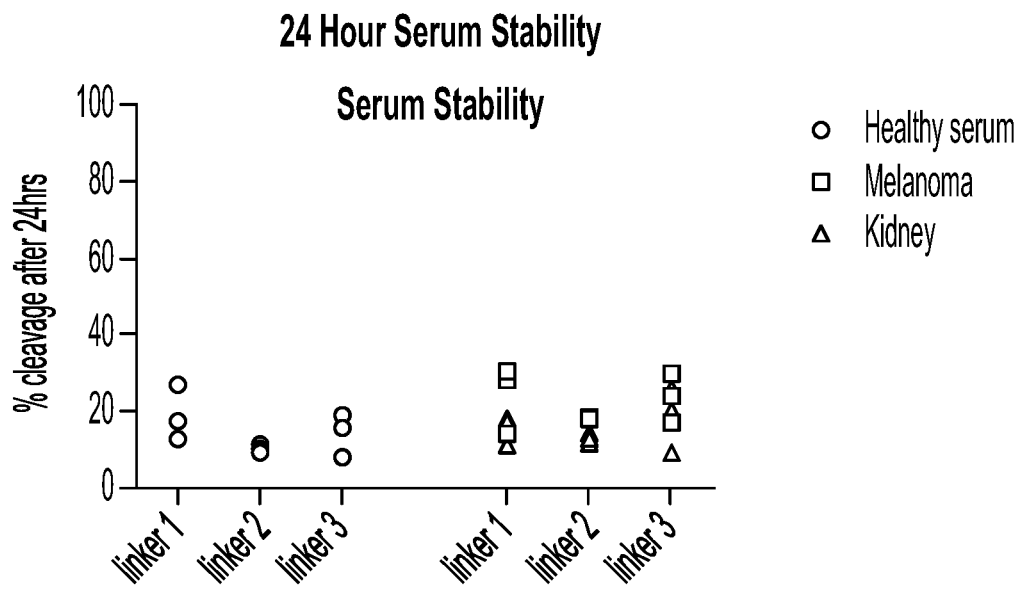
Figure 24B:
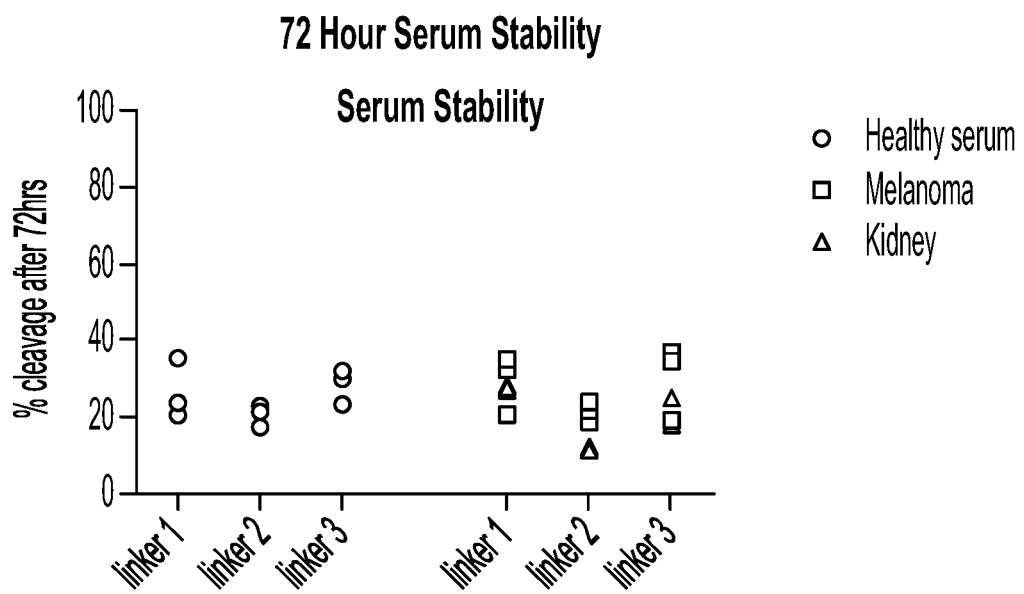

FIGS. 24A-24B are two graphs showing the stability of IL-2 fusion proteins containing Linker-1 (GPAGMKGL, SEQ ID NO: 196), Linker-2 (GPAGLYAQ, SEQ ID NO: 195), or Linker-3 (ALFKSSFP, SEQ ID NO: 198) in human serum in normal patient and a cancer patient. FIG. 24A depicts the stability of the IL-2 fusion proteins containing Linker-1 (GPAGMKGL, SEQ ID NO: 196), Linker-2 (GPAGLYAQ, SEQ ID NO: 195), or Linker-3 (ALFKSSFP, SEQ ID NO: 198) at 24 hours. FIG. 24B depicts the stability of the IL-2 fusion proteins containing Linker-1 (GPAGMKGL, SEQ ID NO: 196), Linker-2 (GPAGLYAQ, SEQ ID NO: 195), or Linker-3 (ALFKSSFP, SEQ ID NO: 198) at 72 hours.

Figure 25B:
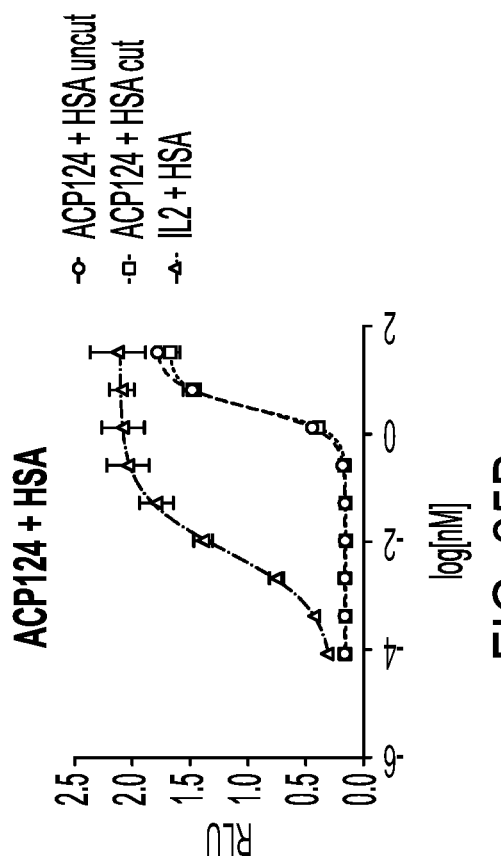
Figure 25A:
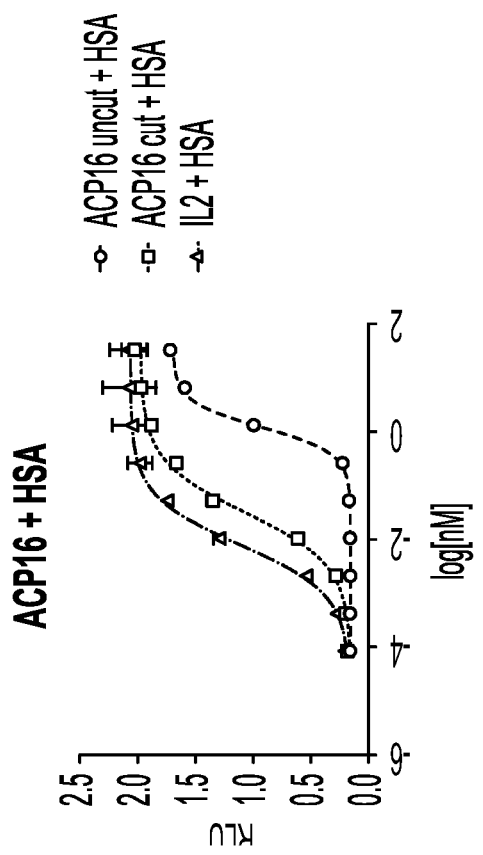
Figure 25C:
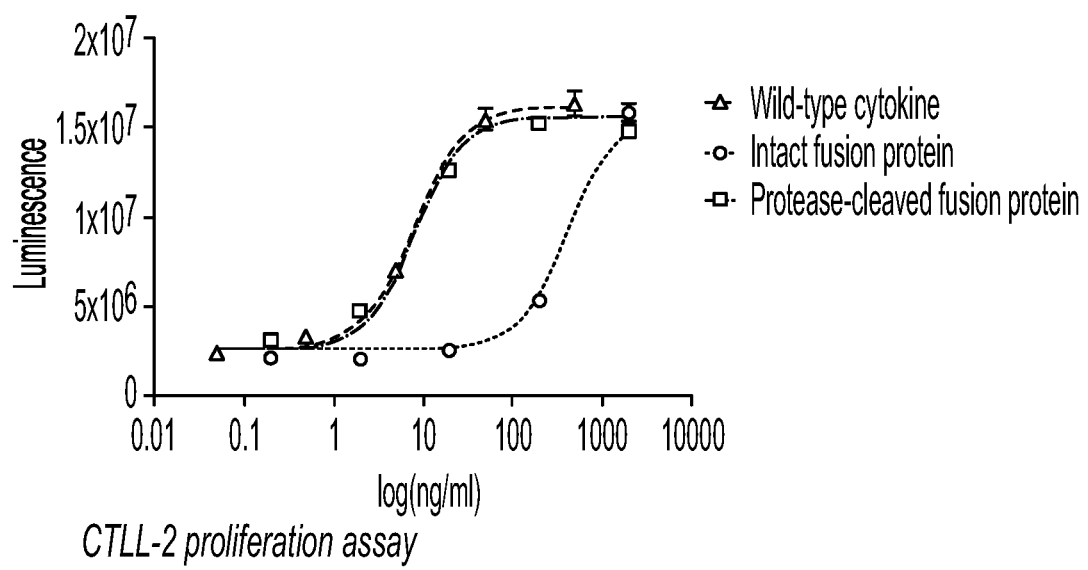

FIGS. 25A and 25B are two graphs showing analysis of ACP16 (FIG. 25A) and ACP124 (FIG. 25B) in a HEKBlue IL-2 reporter assay in the presence of HSA. Circles depict the activity of the uncut polypeptide, squares depict activity of the cut polypeptide, and triangles depict IL-2 alone as a control. FIG. 25C is a graph showing results of a CTLL-2 proliferation assay. CTLL2 cells (ATCC) were plated in suspension at a concentration of 500,000 cells/well in culture media with or without 40 mg/ml human serum albumin (HSA) and stimulated with a dilution series of recombinant hIL2 or activatable hIL2 for 72 hours at 37° C. and 5% $CO_2$. Activity of uncleaved and cleaved activatable ACP16 was tested. Cleaved activatable hIL2 was generated by incubation with active MMP9 Cell activity was assessed using a CellTiter-Glo (Promega) luminescence-based cell viability assay. Triangles show wile-type cytokine, circles depict intact fusion protein, and squares depict protease-cleaved fusion protein.

FIGS. 26A-26C are a series of graphs showing activity of fusion proteins in an HEKBlue IL-12 reporter assay. FIG. 26A is a graph showing activity of cut and uncut ACP11 (a human p40/murine p35 IL12 fusion protein). FIG. 26B is a graph showing analysis of ACP91 (a chimeric IL-12 fusion protein). Squares depict activity of the uncut ACP91 polypeptide, and triangles depict the activity of the cut polypeptide (ACP91+MMP9). EC50 values for each are shown in the table. FIG. 26C is a graph showing analysis of ACP136 (a chimeric IL-12 fusion protein). Squares depict activity of the uncut ACP136 polypeptide, and triangles depict the activity of the cut polypeptide (ACP136+MMP9). EC50 values for each are shown in the table insert.

Figure 27E:
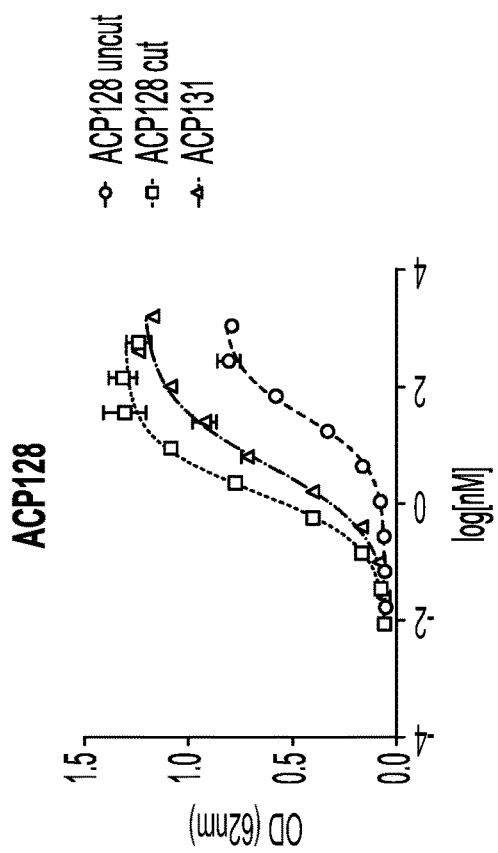
Figure 27D:
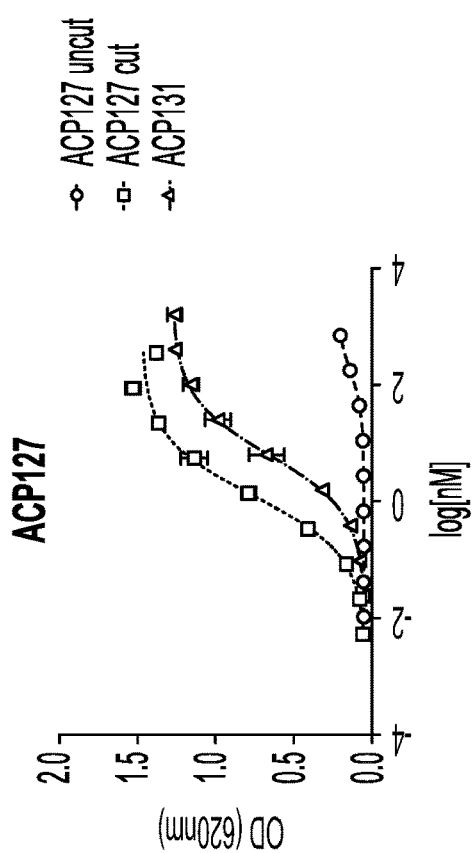
Figure 27F:
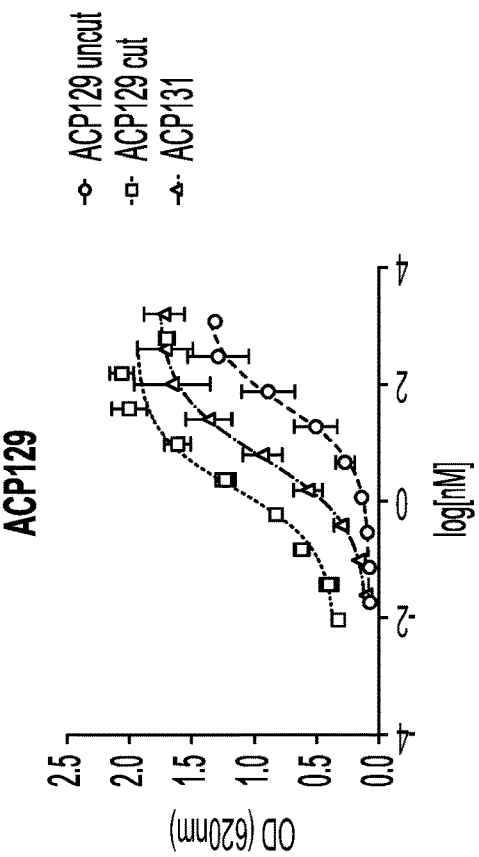

FIGS. 27A-27F are a series of graphs showing that cleaved IL-12 polypeptides are active in a HEKBlue IL2 reporter assay. Fusion proteins are evaluated both uncut (circles) and cut (squares) form, and wild type IL2 is used as a control+HSA for FIGS. 27A-C; ACP131 is used as a control (triangles) for FIGS. 27D-27F. Shown are data for APC31+HSA (FIG. 27A), ACP125 +HSA (FIG. 27B), ACP126+HSA (FIG. 27C), ACP127 (FIG. 27D), ACP128 (FIG. 27E), and ACP129 (FIG. 27F). The EC50 values for each are shown in the table below each graph.

Figure 28B:
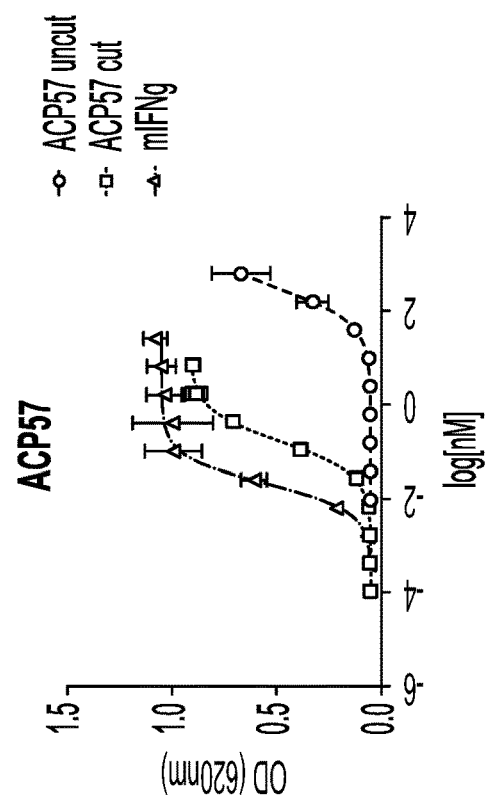
Figure 28D:
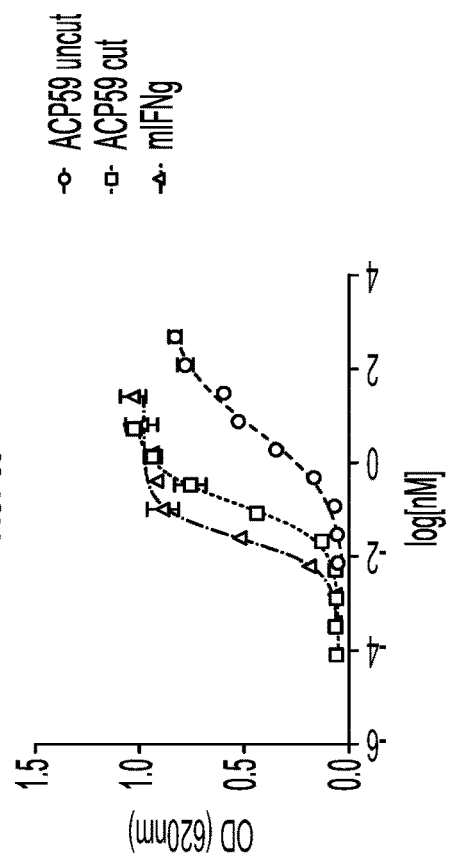
Figure 28A:
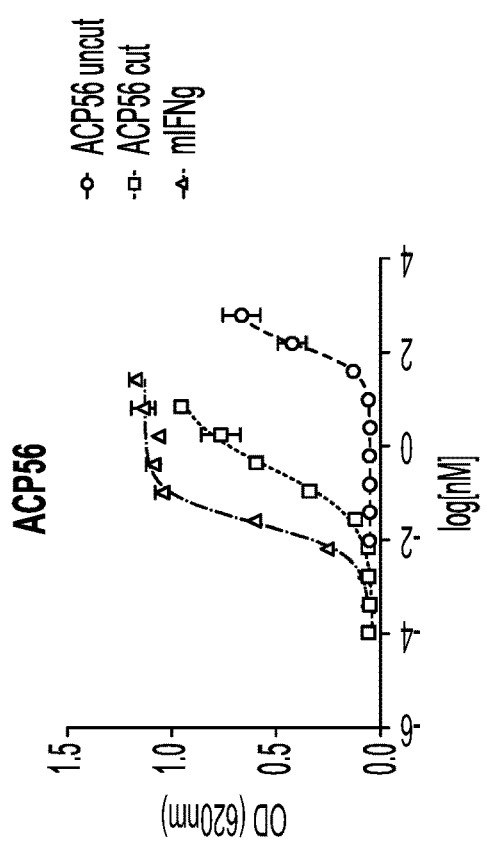
Figure 28C:
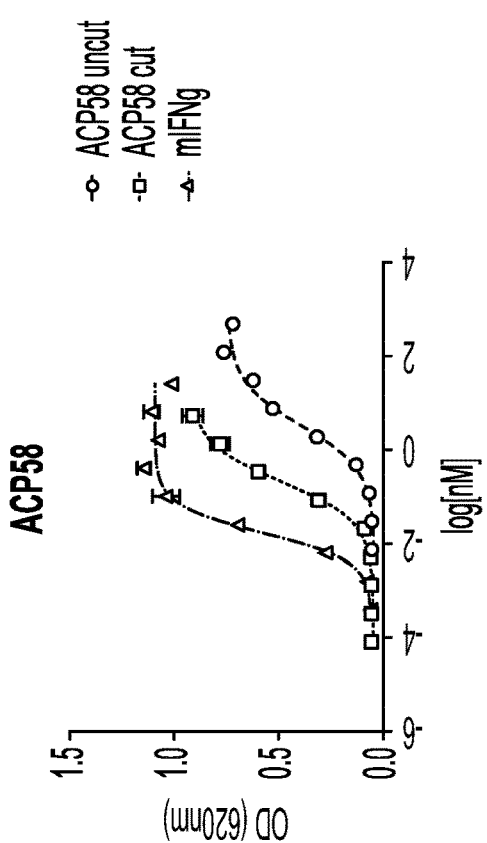
Figure 28F:
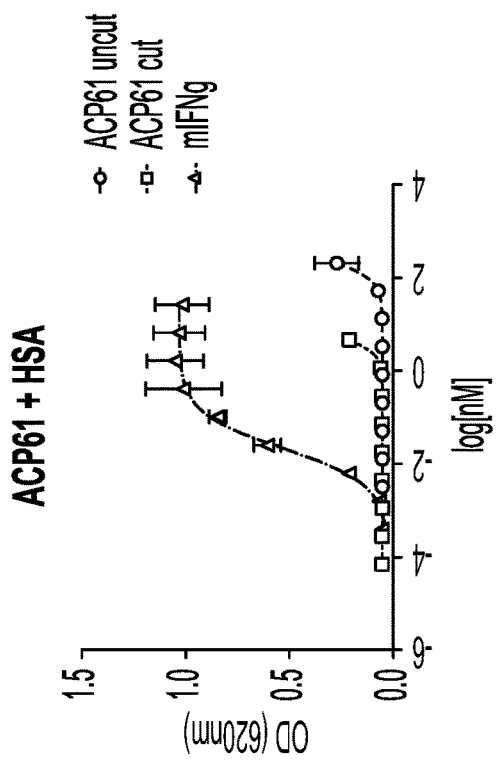
Figure 28E:
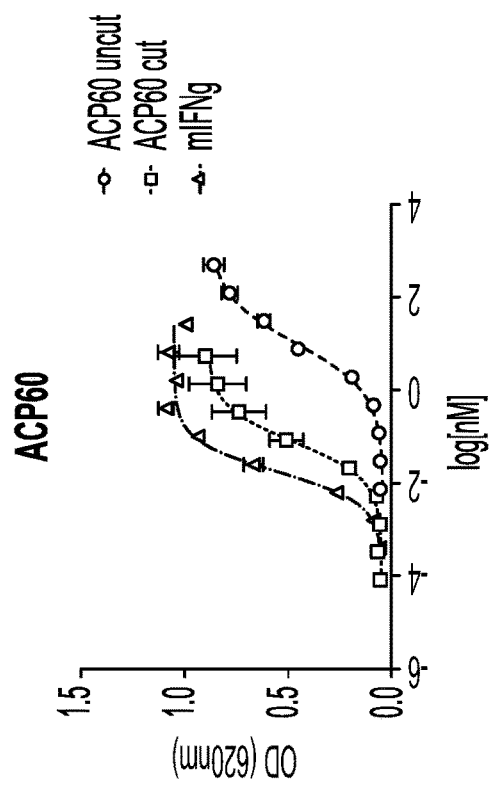
Figure 28H:
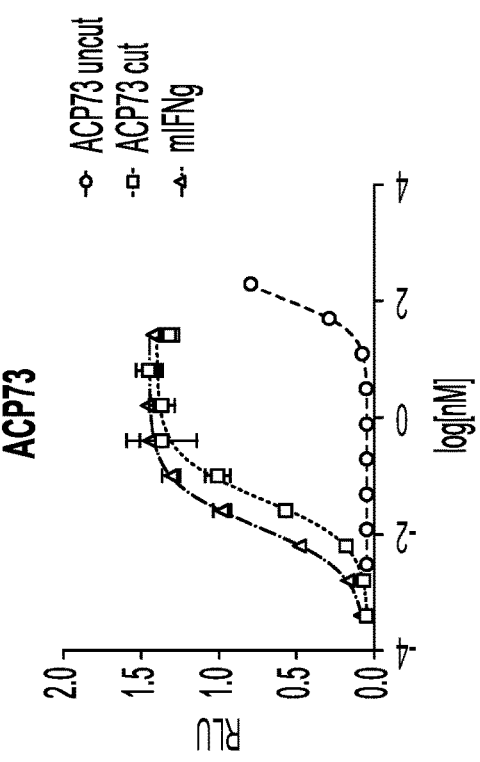
Figure 28G:
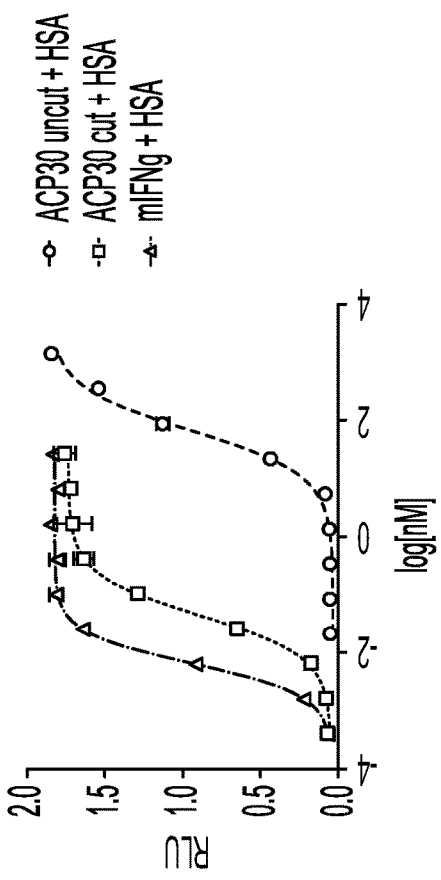

FIGS. 28A-28N are a series of graphs depicting the activity of APC56 (FIG. 28A), APC57 (FIG. 28B) APC58 (FIG. 28C), APC59 (FIG. 28D), APC60 (FIG. 28E), APC61+HSA (FIG. 28F), ACP30+HSA (FIG. 28G), ACP73 (FIG. 28H), ACP70+HSA (FIG. 28I), ACP71 (FIG. 28J), ACP72 (FIG. 28K), ACP 73 (FIG. 28L), ACP74 (FIG. 28M), and ACP75 (FIG. 28N) in a HEKBlue IFNα reporter assay. Each fusion was tested for its activity when cut (squares) and uncut (circles). Analysis of murine IFNγ is included in each graph as a comparator.

Figure 29B:
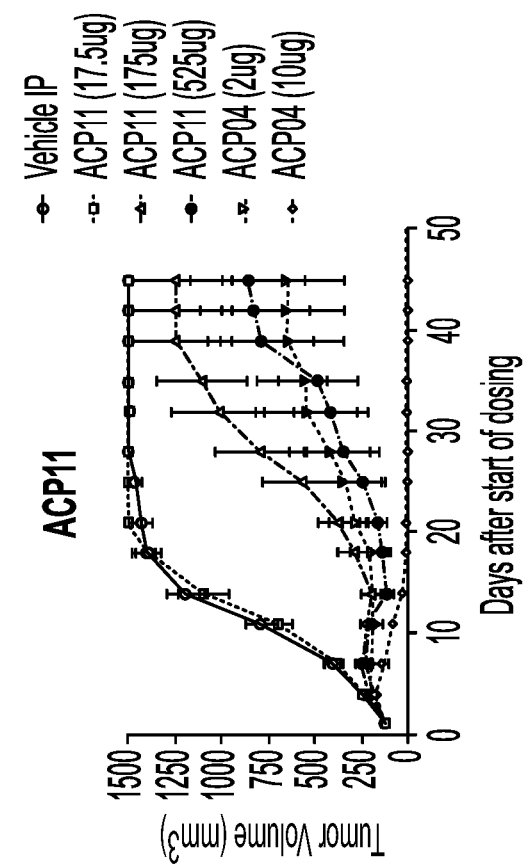
Figure 29A:
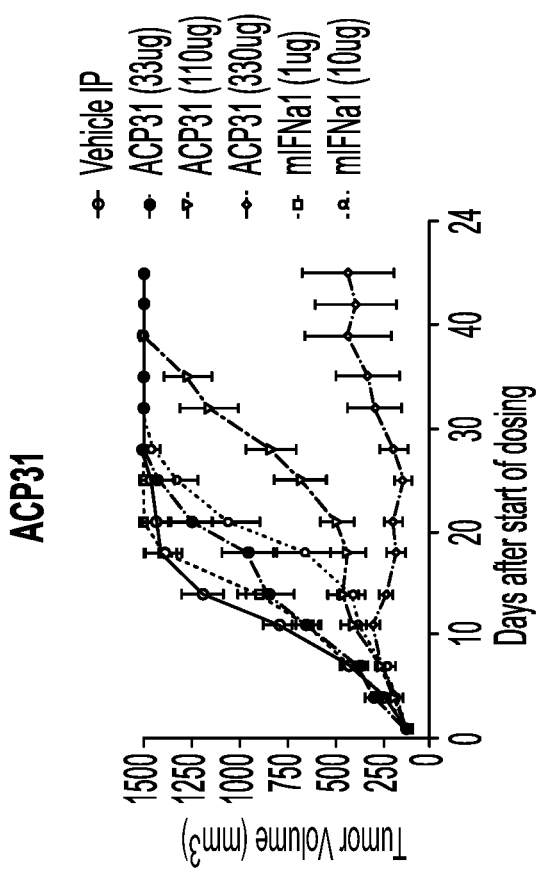

FIGS. 29A-29B is two graphs showing results of analyzing ACP31 (mouse IFNα1 fusion protein) and ACP11 (a human p40/murine p35 IL12 fusion protein) in a tumor xenograft model. FIG. 29A shows tumor volume over time in mice treated with 33 μg ACP31 (circles), 110 μg ACP31 (triangles), 330 μg ACP31 (diamonds), and as controls 1 μg murine wild type IFNα1 (dashed line, squares) and 10 μg mIFNα1 (dashed line, small circles). Vehicle alone is indicated by large open circles. The data show tumor volume decreasing over time in a dose-dependent manner in mice treated with ACP31. FIG. 29B shows tumor volume over time in mice treated with 17.5 μg ACP11 (squares), 175 μg ACP11 (triangles), 525 μg ACP11 (circles), and as controls 2 μg ACP04 (dashed line, triangles) and 10 μg ACP04 (dashed line, diamonds). Vehicle alone is indicated by large open circles. The data show tumor volume decreasing over time in a dose-dependent manner in mice treated with both ACP11 and ACP04 (a human p40/murine p35 IL12 fusion protein).

FIGS. 30A-30F are a series of spaghetti plots showing tumor volume over time in a mouse xenograft tumor model in mice each treated with vehicle alone (FIG. 30A), 2 μg ACP04 (FIG. 30B), 10 μg ACP04 (FIG. 30C), 17.5 μg ACP11 (FIG. 30D), 175 μg ACP11 (FIG. 30E), and 525 μg ACP11 (FIG. 30F). Each line represents a single mouse.

Figure 31B:
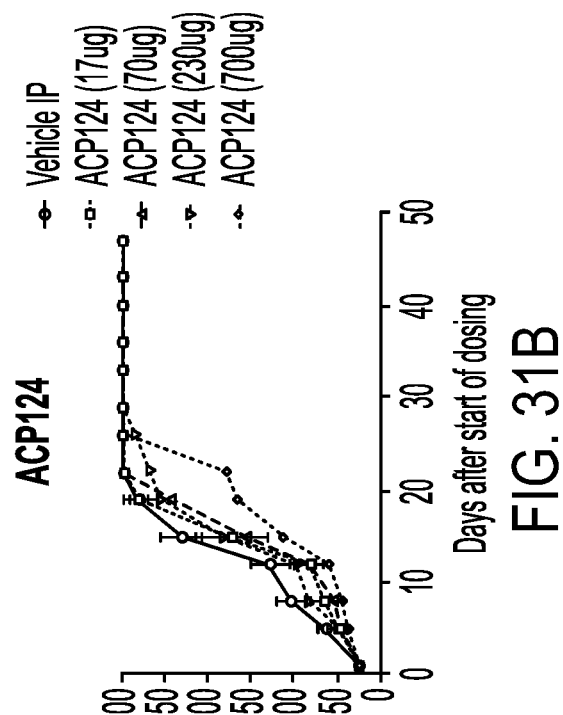
Figure 31A:
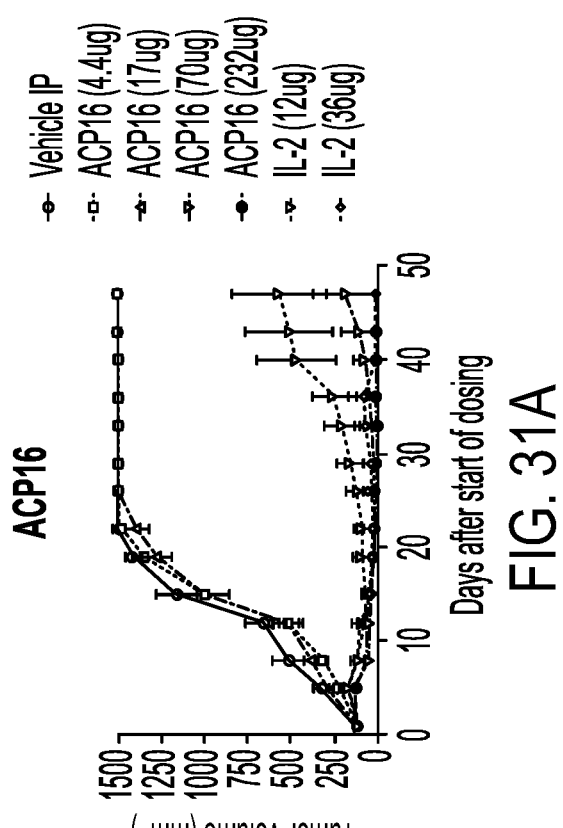
Figure 31C:
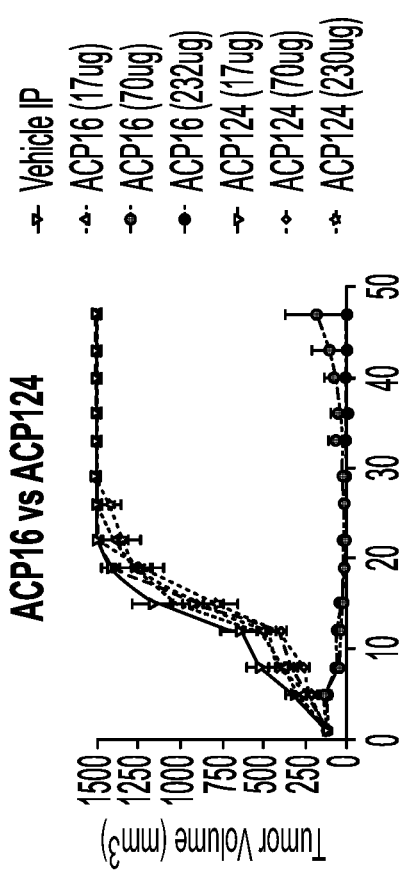

FIGS. 31A-31C depicts three graphs showing results of analyzing ACP16 and ACP124 in a tumor xenograft model. FIG. 31A shows tumor volume over time in mice treated with 4.4 μg ACP16 (squares), 17 μg ACP16 (triangles), 70 μg ACP16 (downward triangles), 232 μg ACP16 (dark circles), and as a comparator 12 μg wild type IL-2 (dashed line, triangles) and 36 μg wild type IL-2 (dashed line, diamonds). Vehicle alone is indicated by large open circles. The data show tumor volume decreasing over time in a dose-dependent manner in mice treated with ACP16 at higher concentrations. FIG. 31B shows tumor volume over time in mice treated with 17 μg ACP124 (squares), 70 μg ACP124 (triangles), 230 μg ACP124 (downward triangles), and 700 μg ACP124 (diamonds). Vehicle alone is indicated by large open circles. FIG. 31C shows tumor volume over time in mice treated with 17 μg ACP16 (dashed line, triangles), 70 μg ACP16 (circles), 232 μg ACP16 (dark circles), and as a comparator 17 μg ACP124 (downward triangles) 70 μg ACP124 (dashed line, diamonds), 230 μg ACP124 (dashed line, stars). Vehicle alone is indicated by dark downward triangles. The data show tumor volume decreasing over time in a dose-dependent manner in mice treated with ACP16, but not ACP124.

Figure 32F:
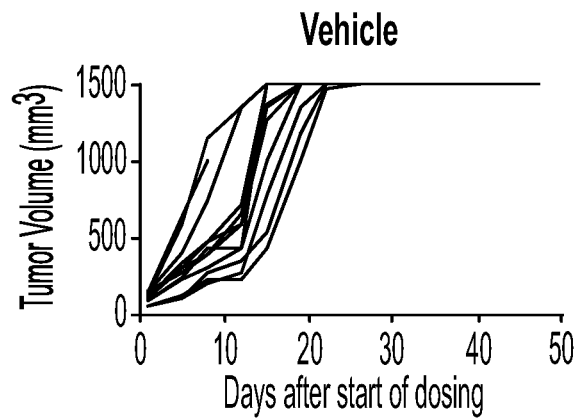
Figure 32G:
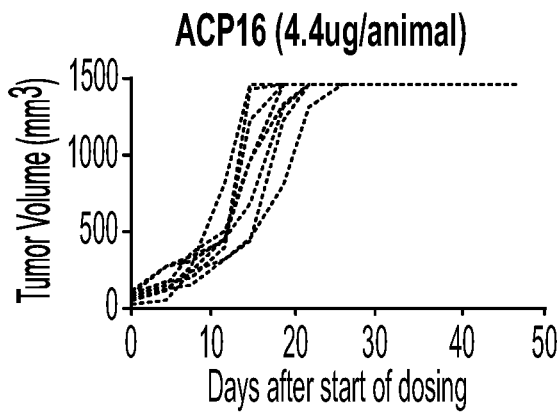
Figure 32H:
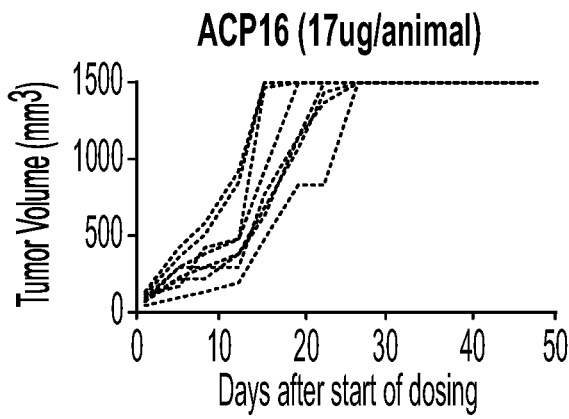
Figure 32I:
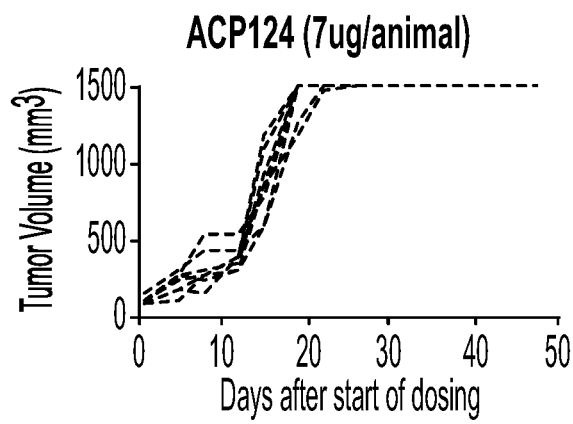
Figure 32J:
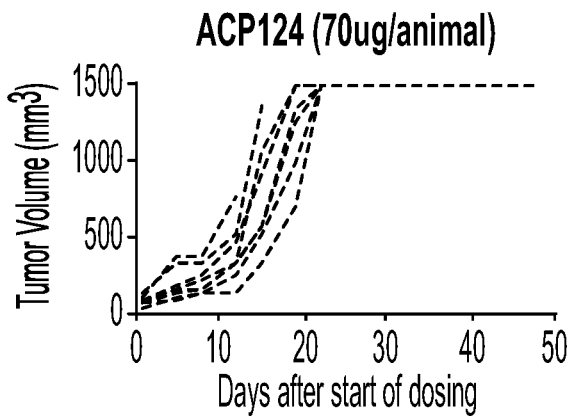
Figure 32K:
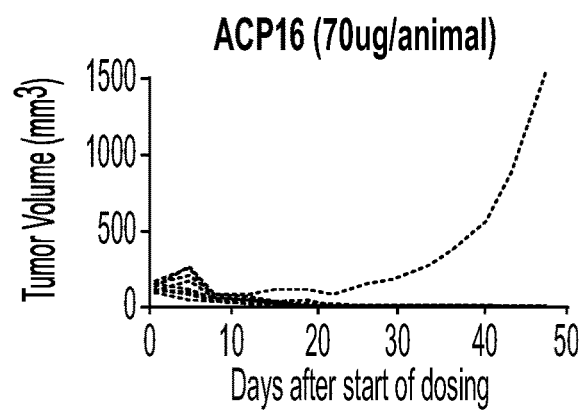
Figure 32L:
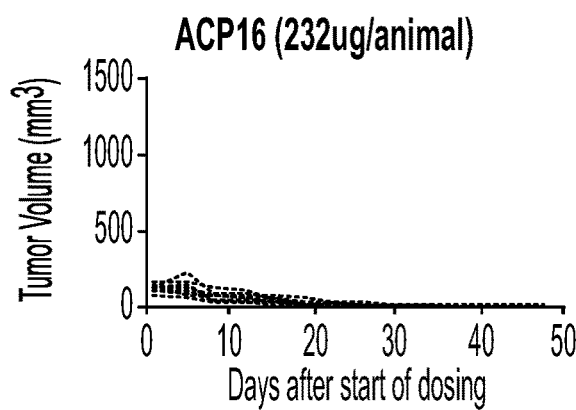
Figure 32M:
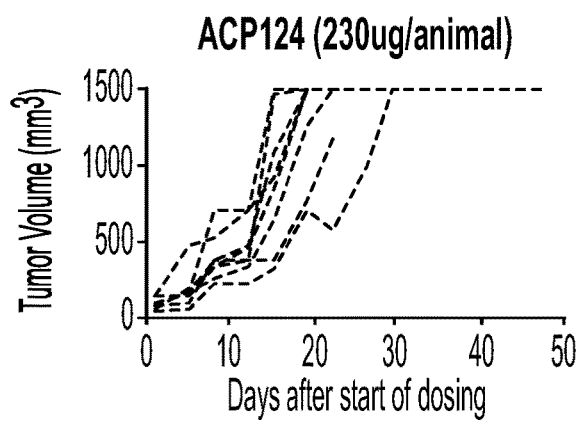
Figure 32N:
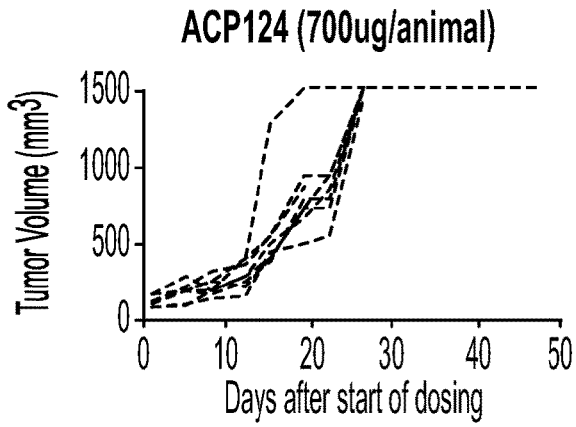
Figure 32O:
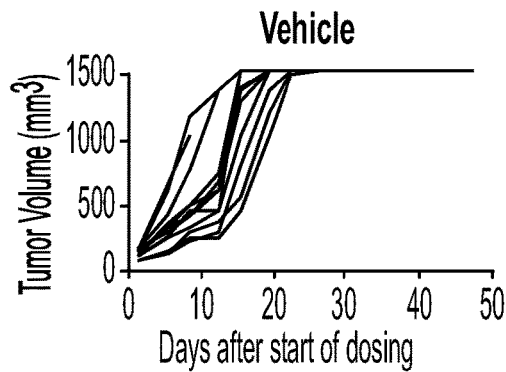
Figure 32P:
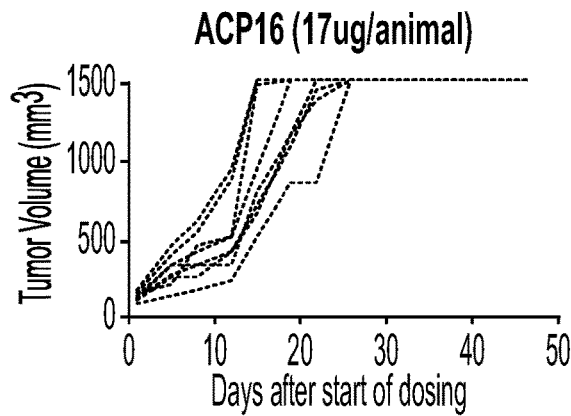
Figure 32Q:
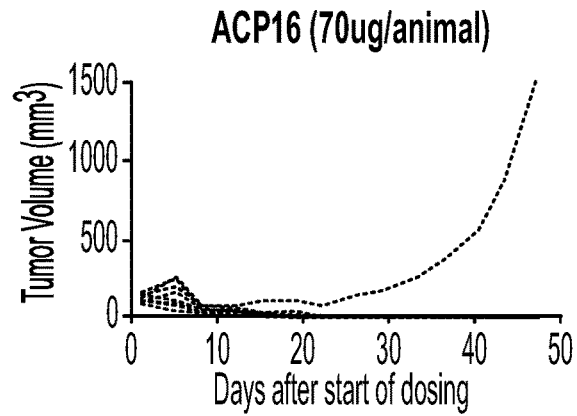
Figure 32R:
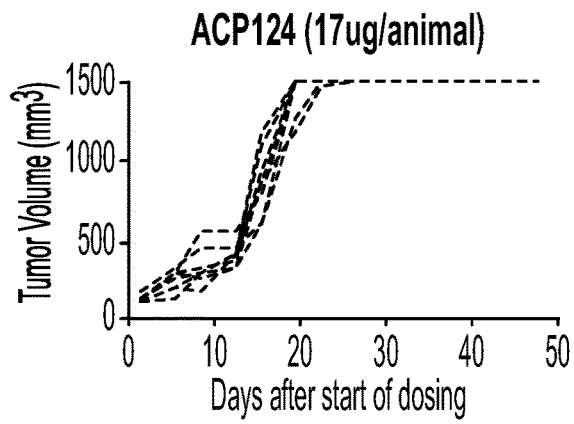
Figure 32S:
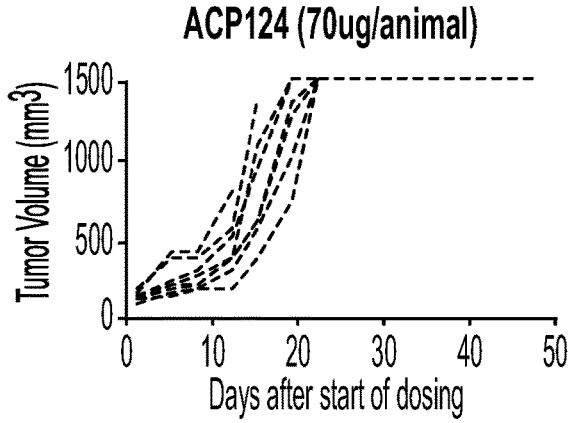
Figure 32T:
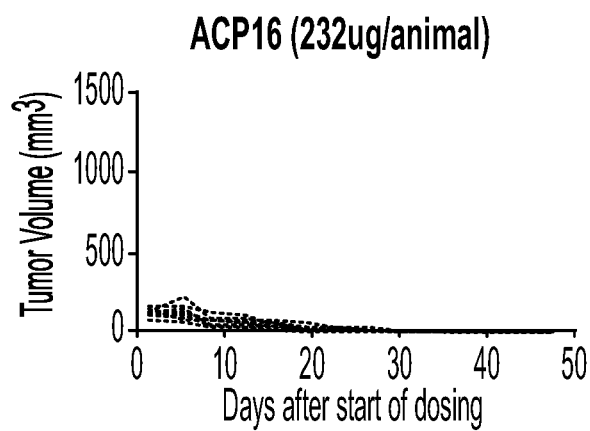
Figure 32U:
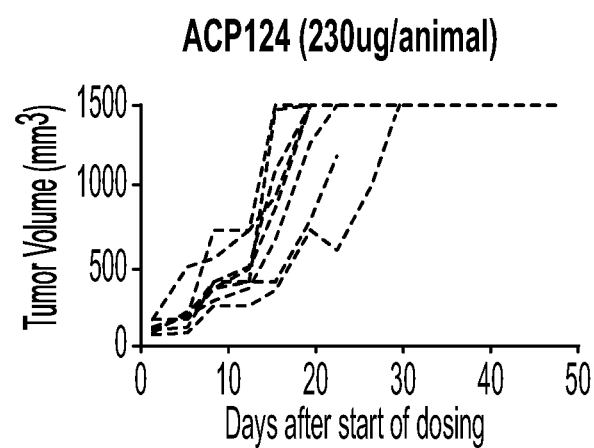

FIGS. 32A-32U are a series of spaghetti plots showing activity of fusion proteins in an MC38 mouse xenograft model. Each line in the plots is a single mouse.

Figure 33:
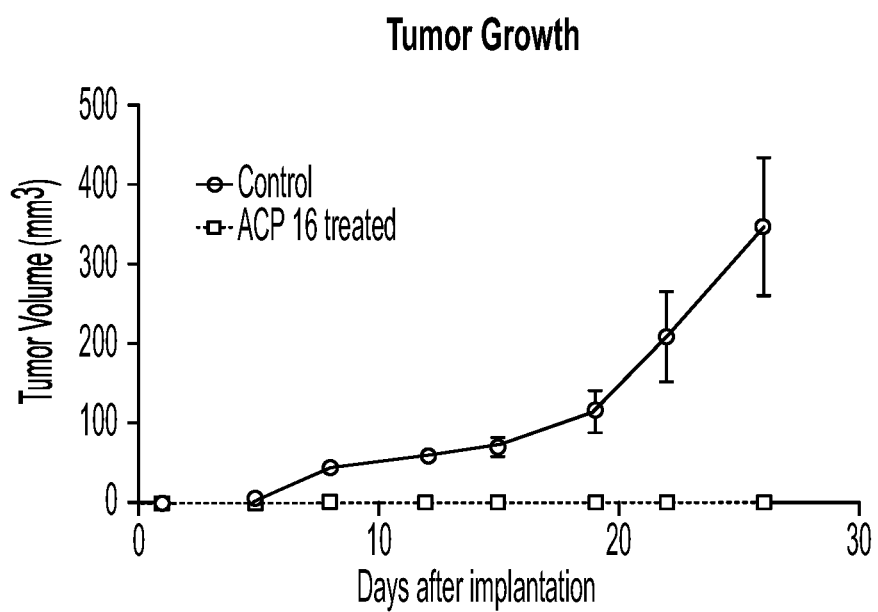

FIG. 33 is a graph showing tumor volume over time in a mouse xenograft model showing tumor growth in control mice (open circles) and AP16-treated mice (squares).

FIGS. 34A-34D are a series of survival plots showing survival of mice over time after treatment with cleavable fusion proteins. FIG. 34A shows data for mice treated with vehicle alone (dotted line), 17 μg ACP16 (dark line), and 17 μg ACP124 (dashed line). FIG. 34B shows data for mice treated with vehicle alone (dotted line), 70 μg ACP16 (dark line), and 70 μg ACP124 (dashed line). FIG. 34C shows data for mice treated with vehicle alone (dotted line), 232 μg ACP16 (dark line), and 230 μg ACP124 (dashed line). FIG. 34D shows data for mice treated with vehicle alone (dotted line), 232 μg ACP16 (dark line), and 700 μg ACP124 (dashed line).

Figure 1A:
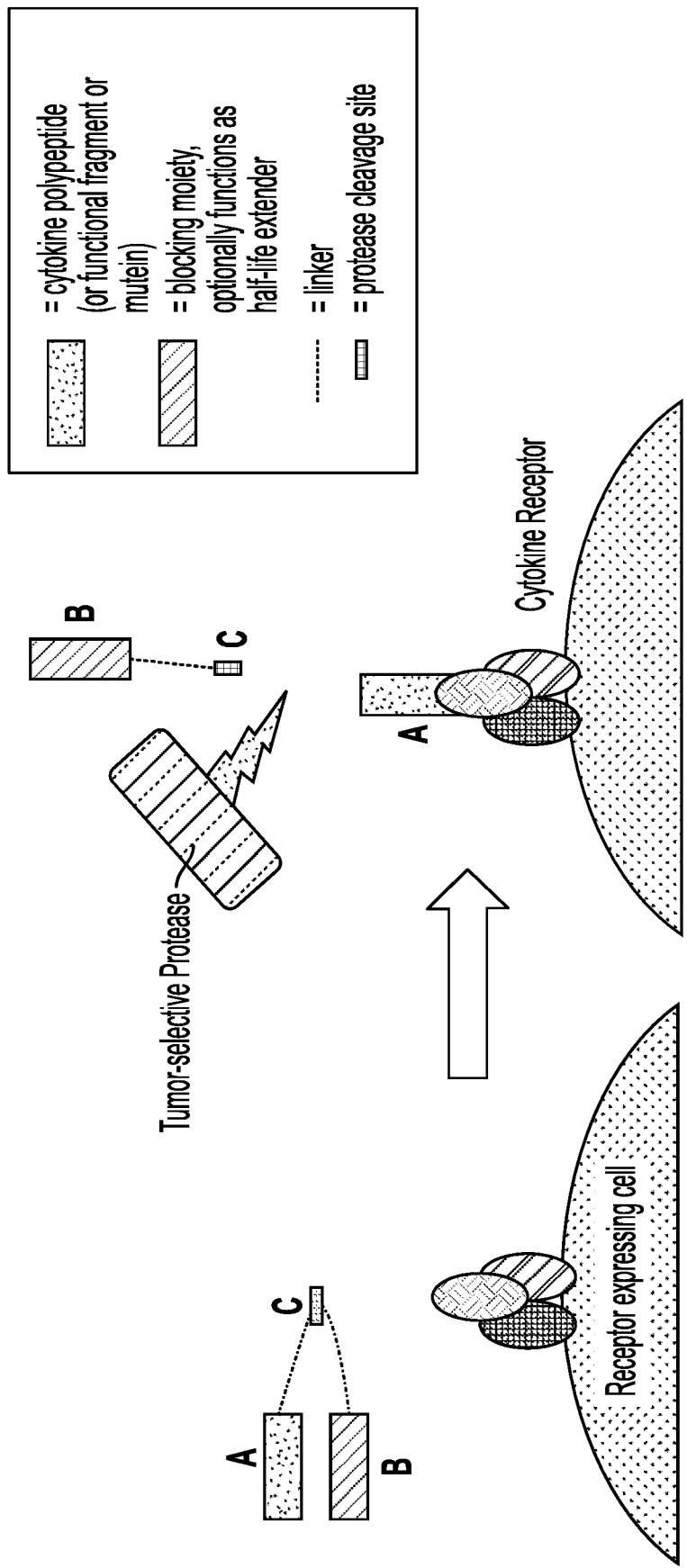
Figure 1B:
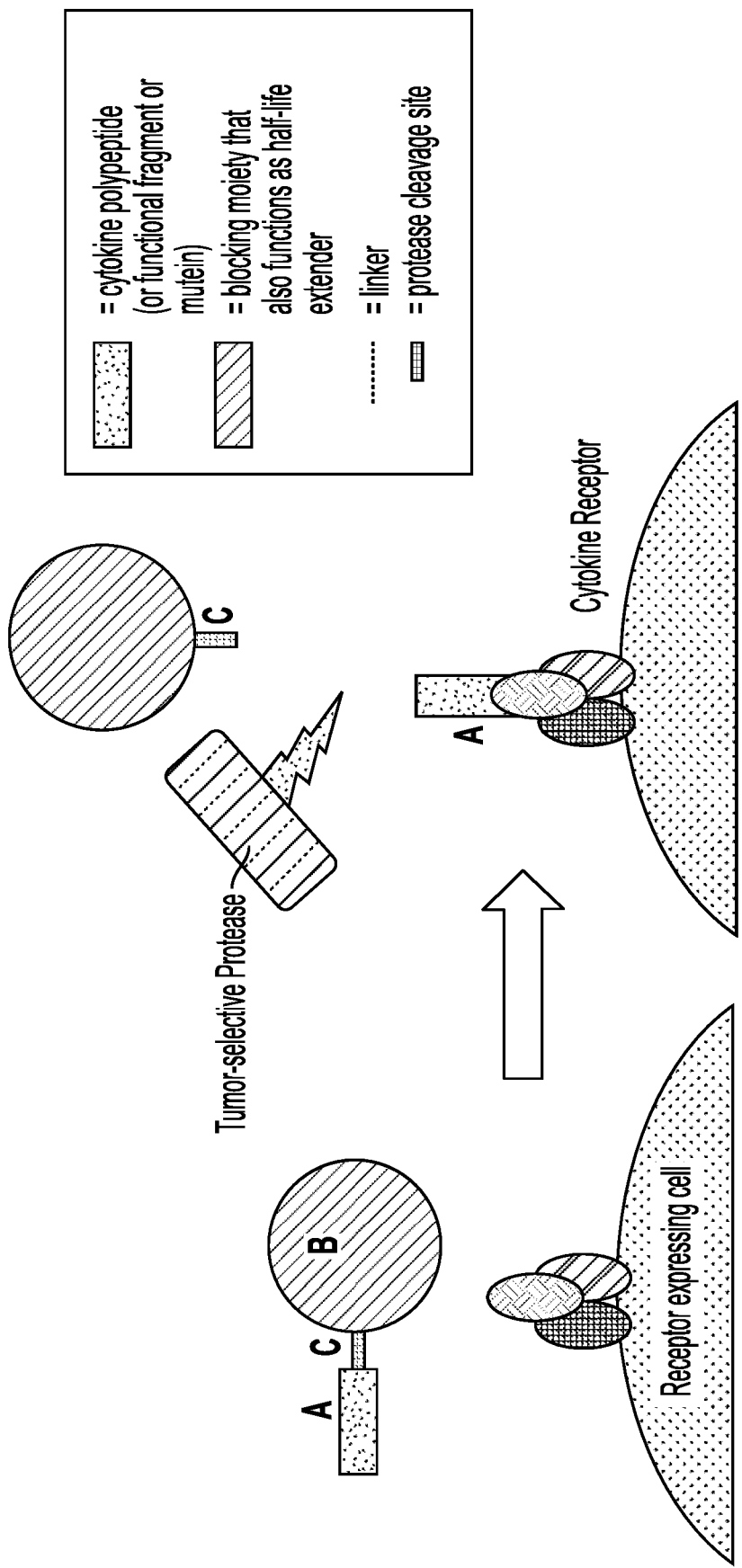
Figure 1C:
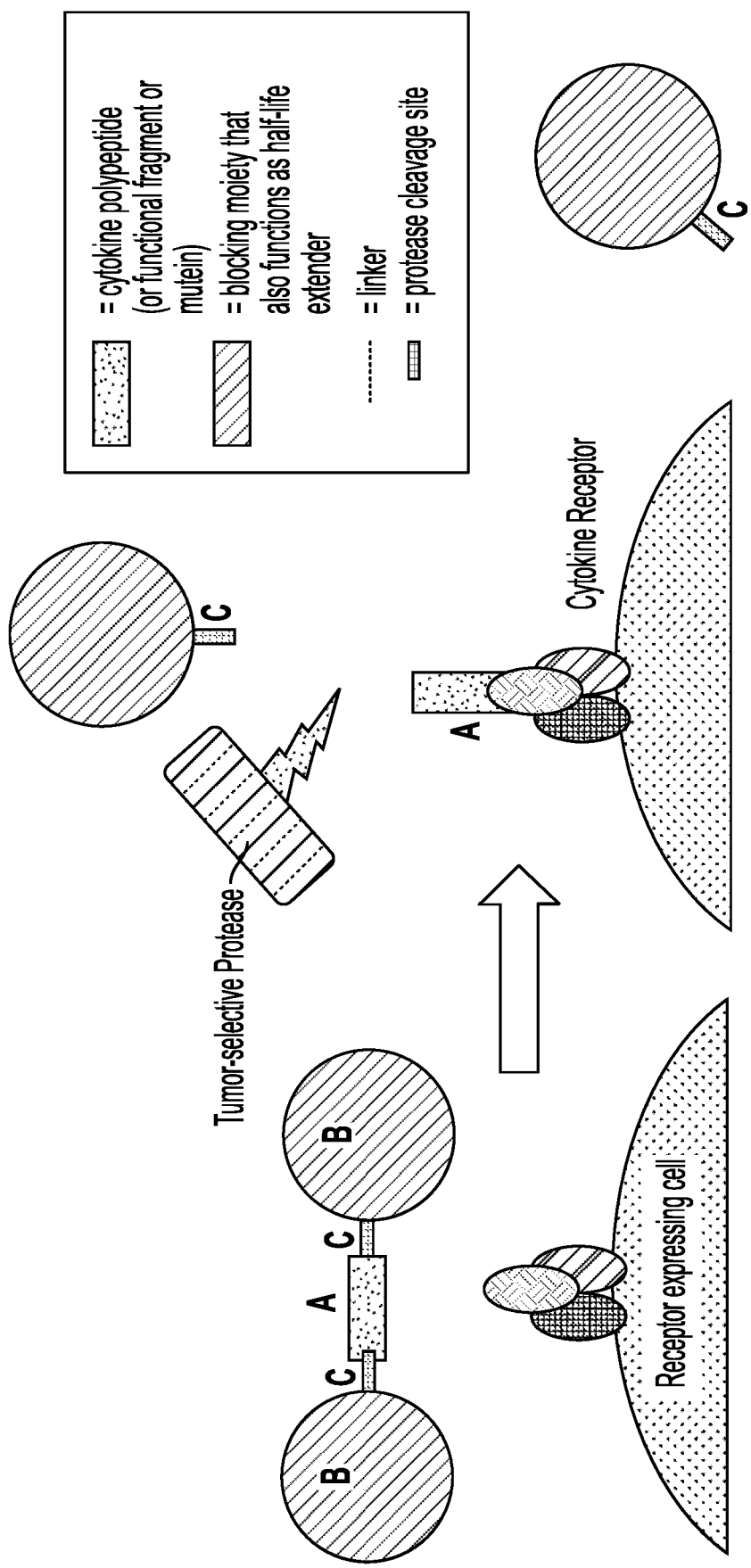
Figure 1D:
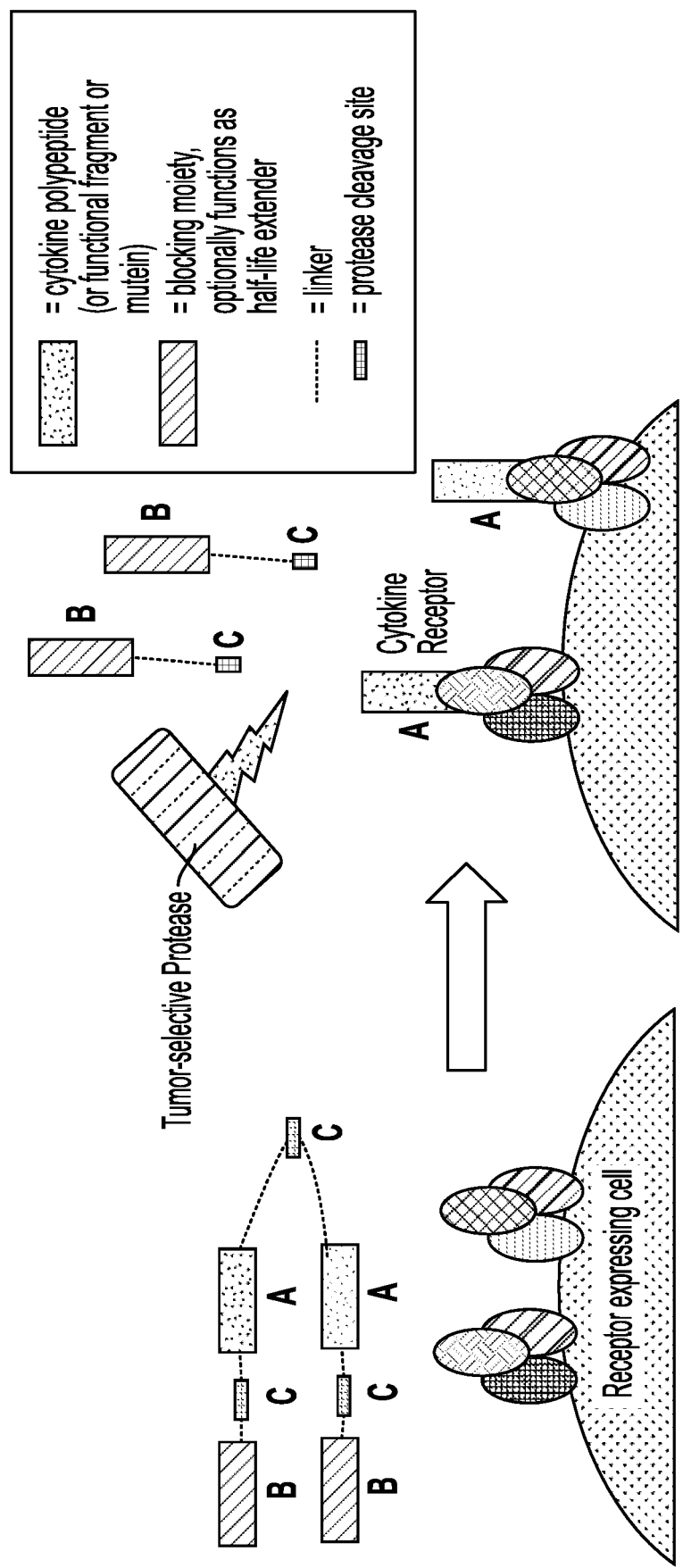
Figure 2:
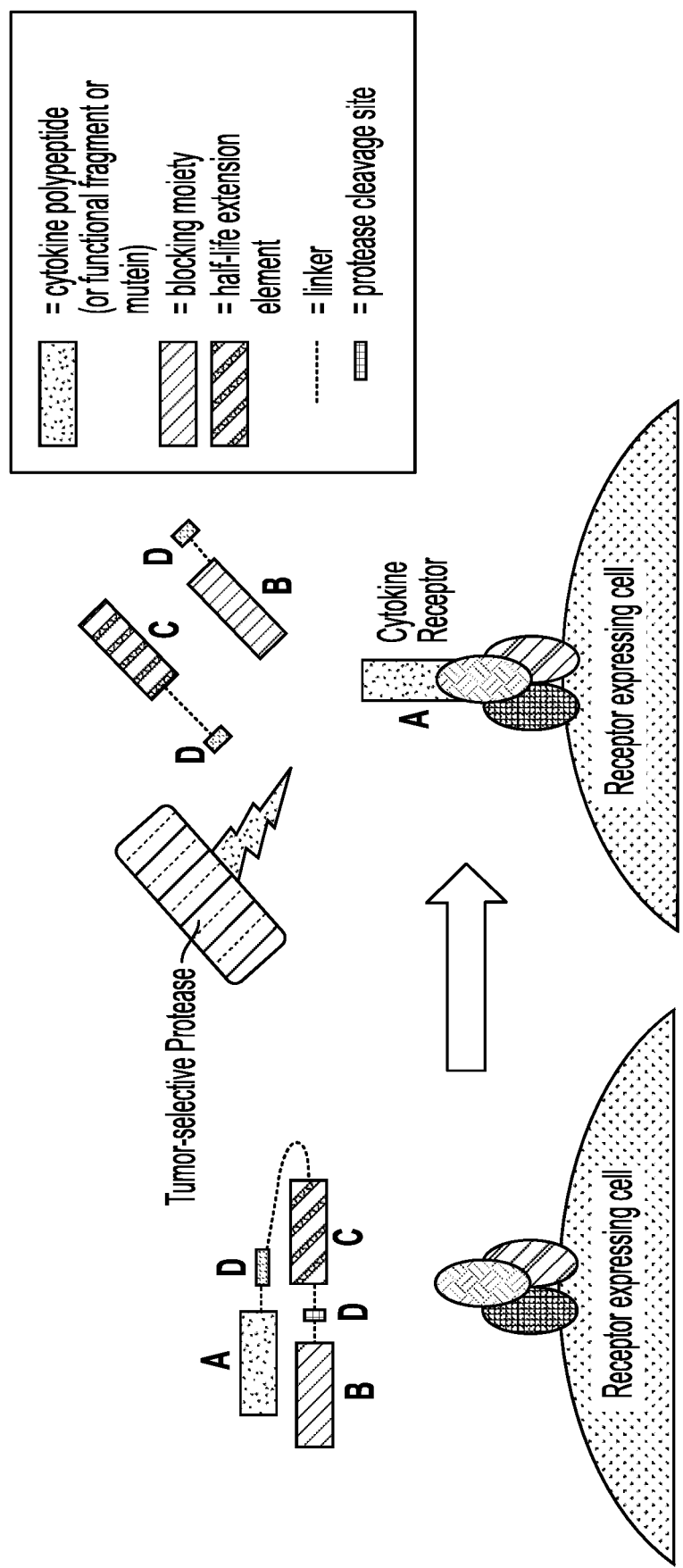
Figure 3:
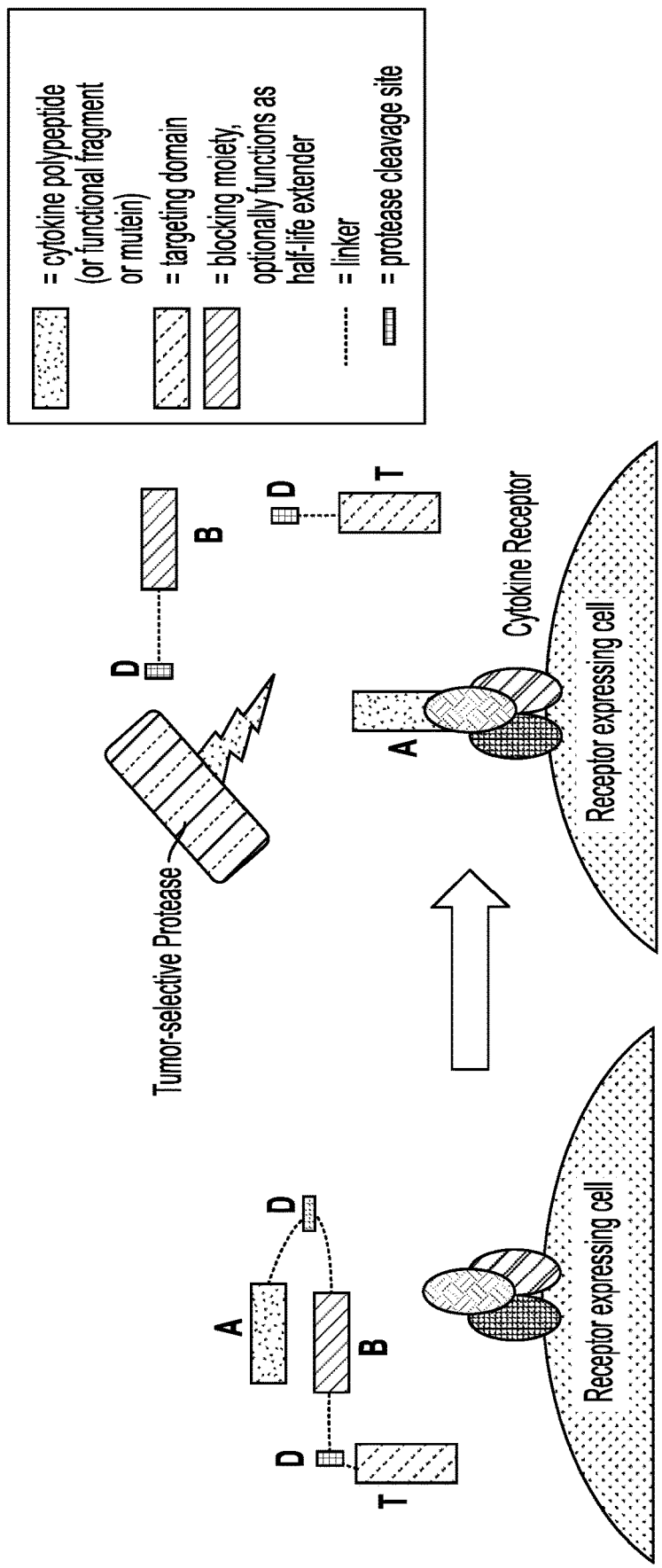
Figure 4A:
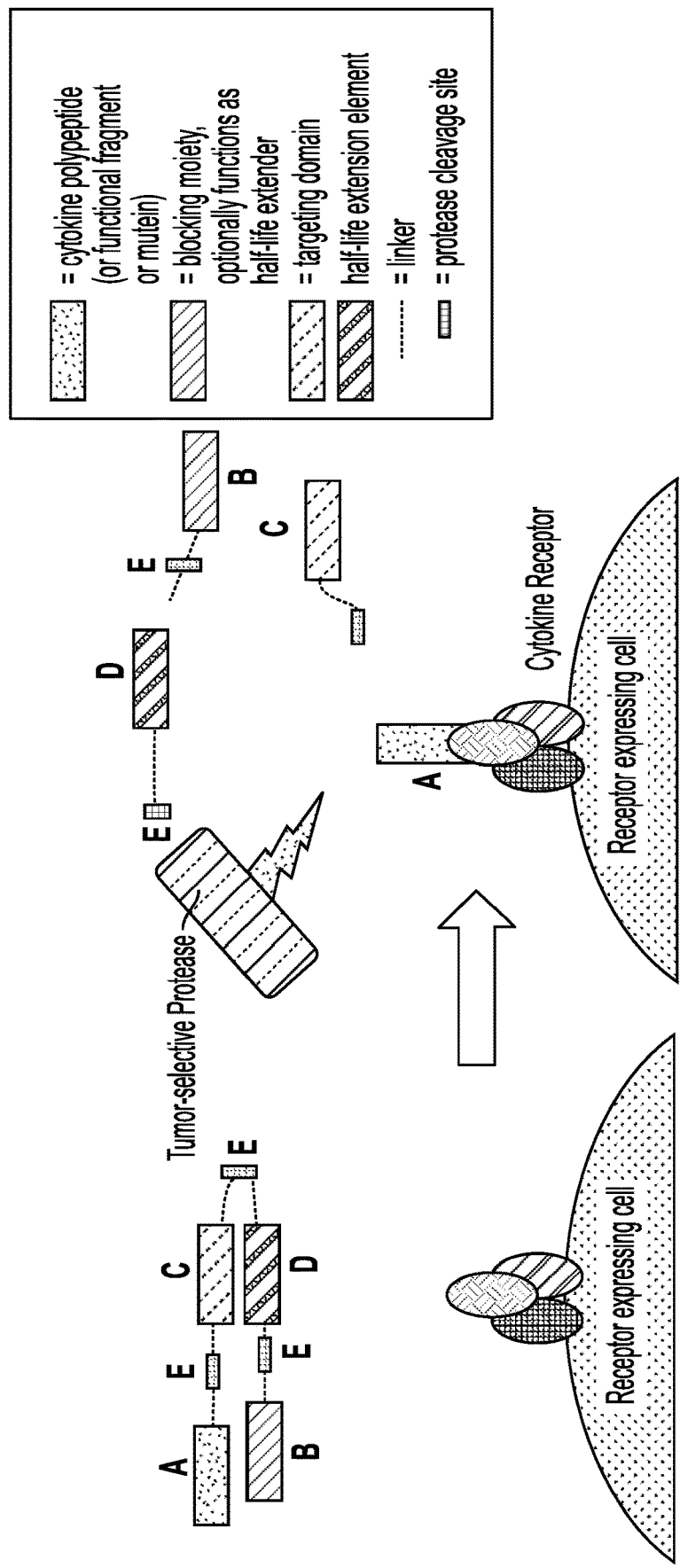
Figure 4B:
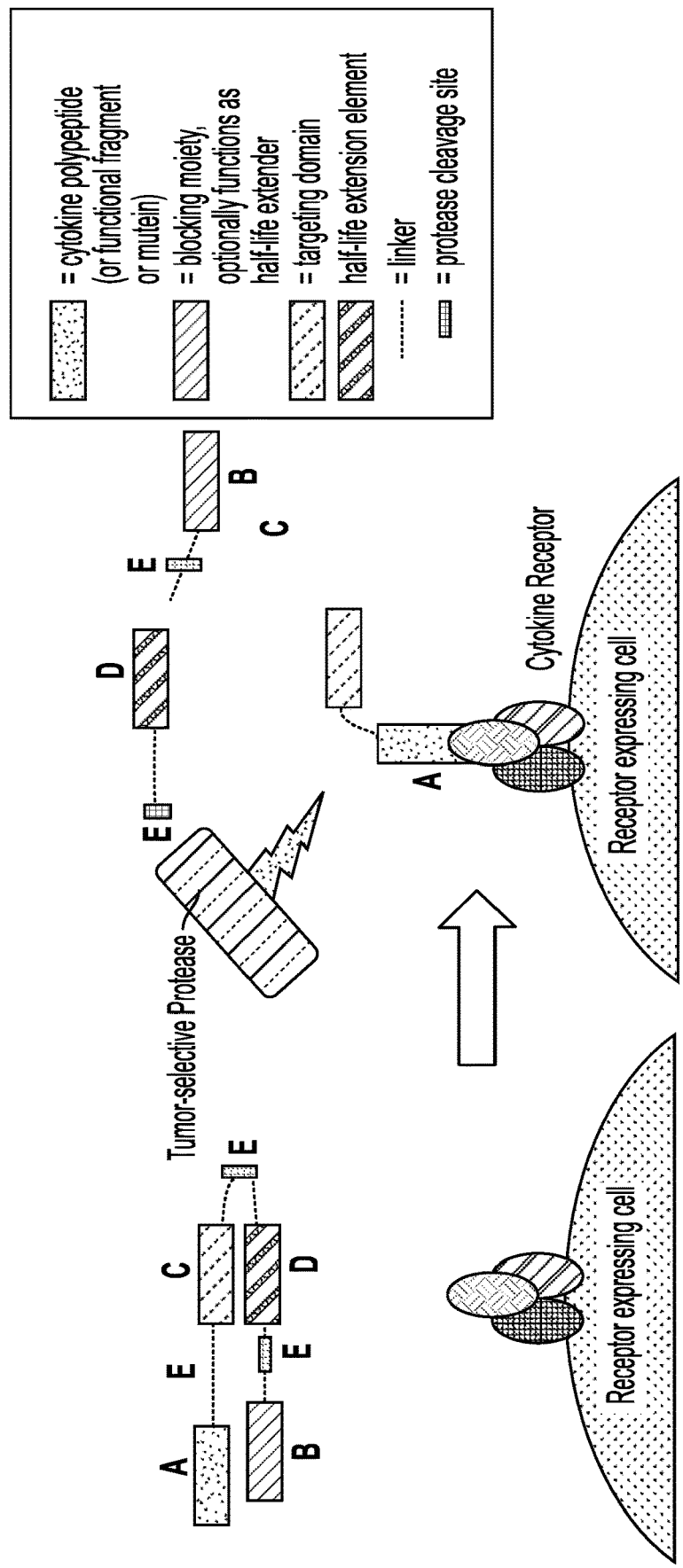
Figure 35A:
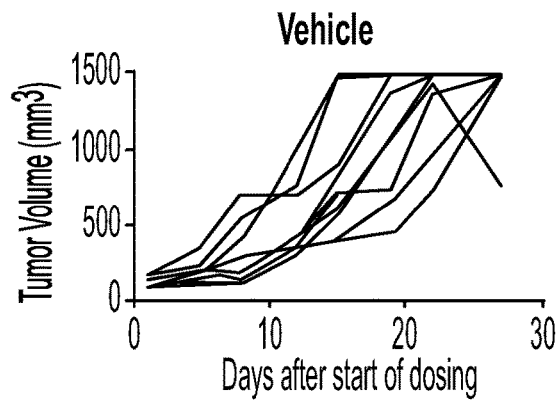
Figure 35B:
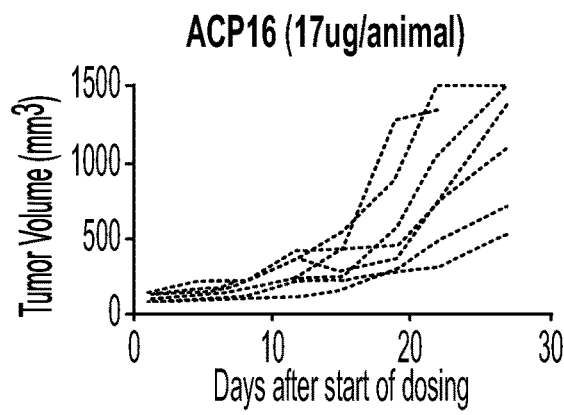
Figure 35C:
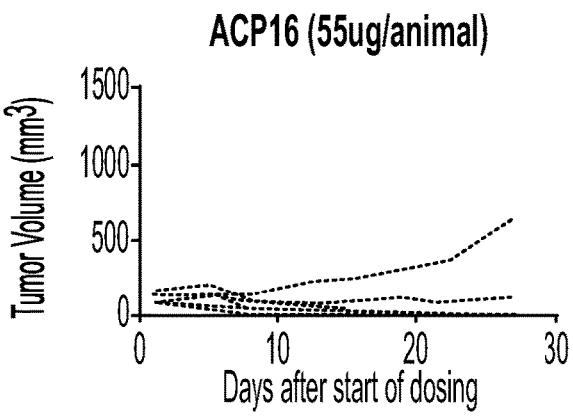
Figure 35D:
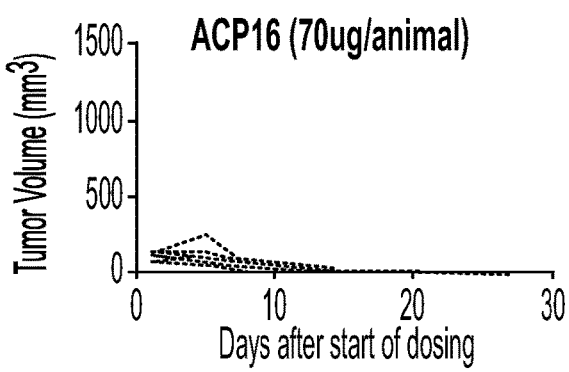
Figure 35E:
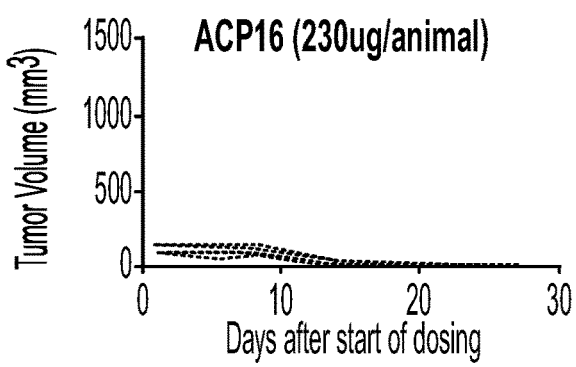
Figure 35F:
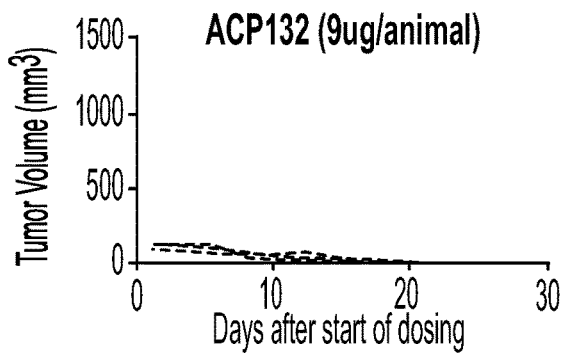
Figure 35G:
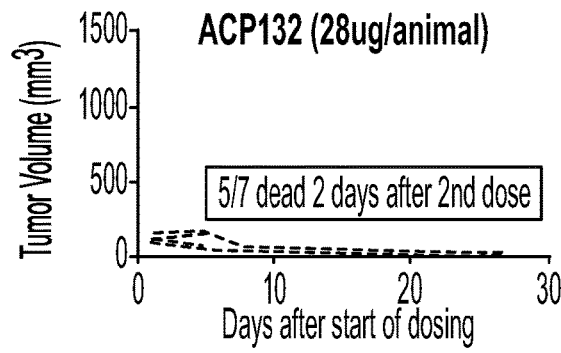
Figure 35H:
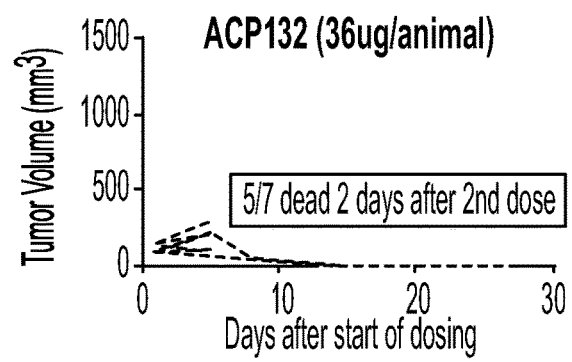
Figure 35I:
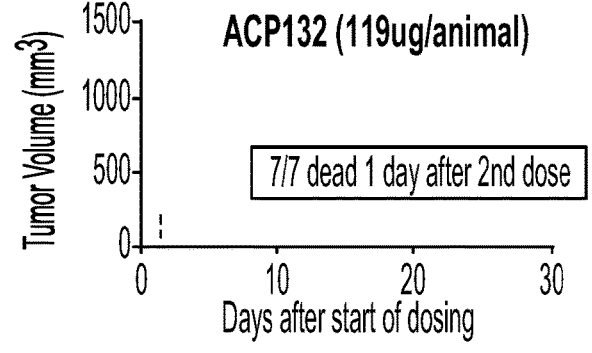
Figure 35J:
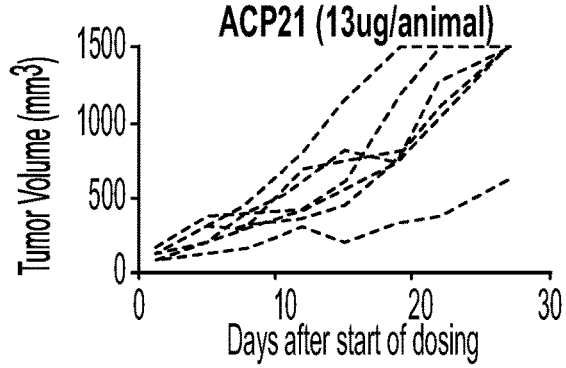
Figure 35K:
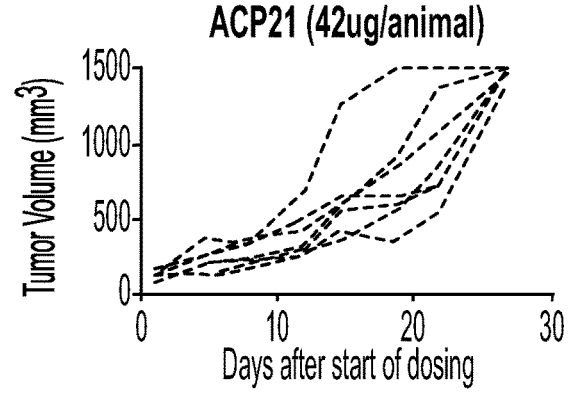
Figure 35L:
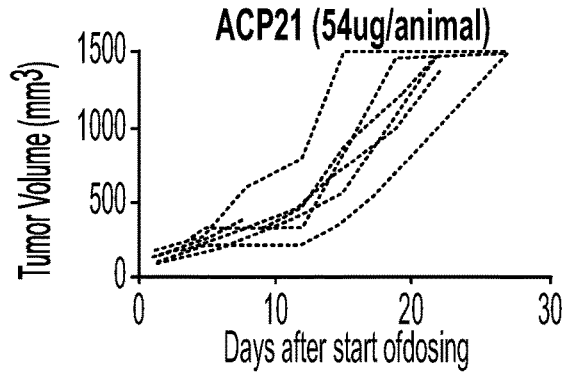
Figure 35M:
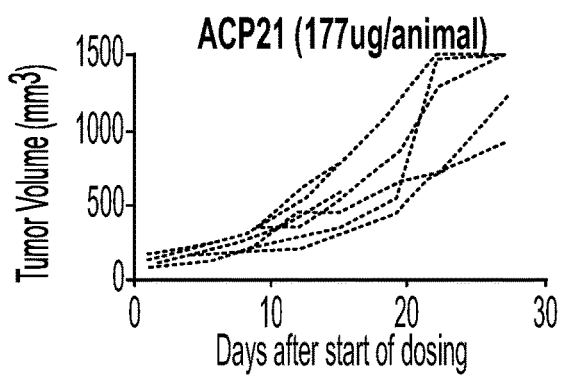
Figure 36:
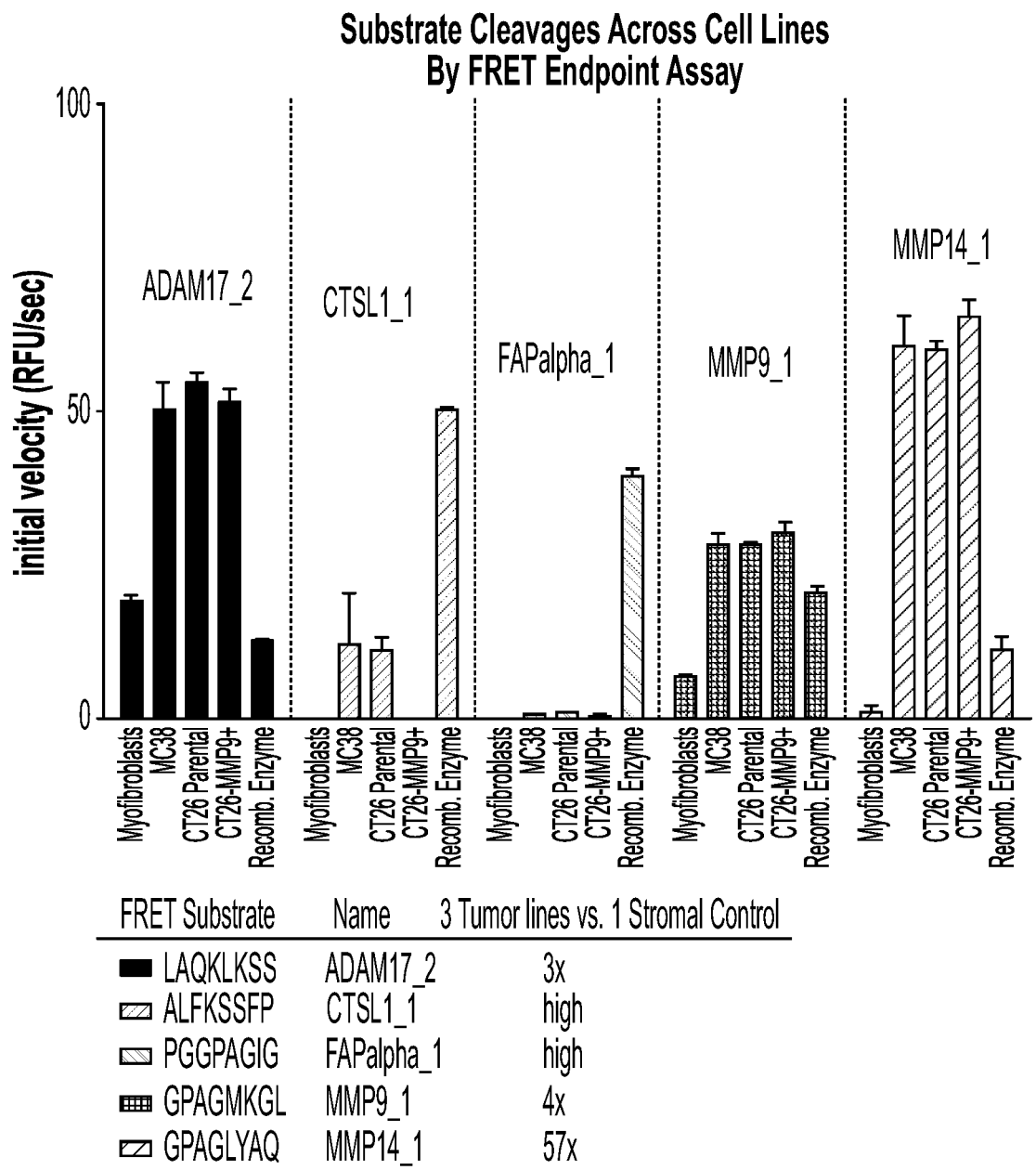

FIGS. 35A-35M are a series of spaghetti plots showing activity of fusion proteins in an MC38 mouse xenograft model. All mouse groups were given four doses total except for the highest doses of APC132, wherein fatal toxicity was detected after 1 week/2 doses. FIG. 35A shows tumor volume over time for mice treated with vehicle. FIGS. 35B-3E shows tumor volume over tume in mice treated with ACP16 at 17 μg/animal (FIG. 35B), 55 μg/animal (FIG. 35C), 70 μg/animal (FIG. 35C), and 230 μg/animal 35E. FIGS. 35F-35I shows tumor volume over time for mice treated with ACP132 at 9 μg/animal (FIG. 35F), 28 μg/animal (FIG. 35G). 36 μg/animal (FIG. 35H), and 119 μg/animal (FIG. 35I). FIGS. 35J-35M shows tumor volume over time for mice treated with ACP21 at 13 μg/animal (FIG. 35J), 42 μg/animal (FIG. 35K), 54 μg/animal (FIG. 35L), and 177 μg/animal (FIG. 35M). Each line in the plots represents an individual animal FIG. 36 is a schematic illustrating substrate cleavage activity in conditioned complete (+FBS) media by FRET endpoint assay across four cell lines. The ratio of tumor vs control activity was approximated by averaging the three tumor cell lines and comparing to the control myofibroblast cell line where signal was detectable. FIG. 36 discloses SEQ ID NOs: 201, 198, 197, 196 and 195, respectively, in order of appearance.

Figure 37:
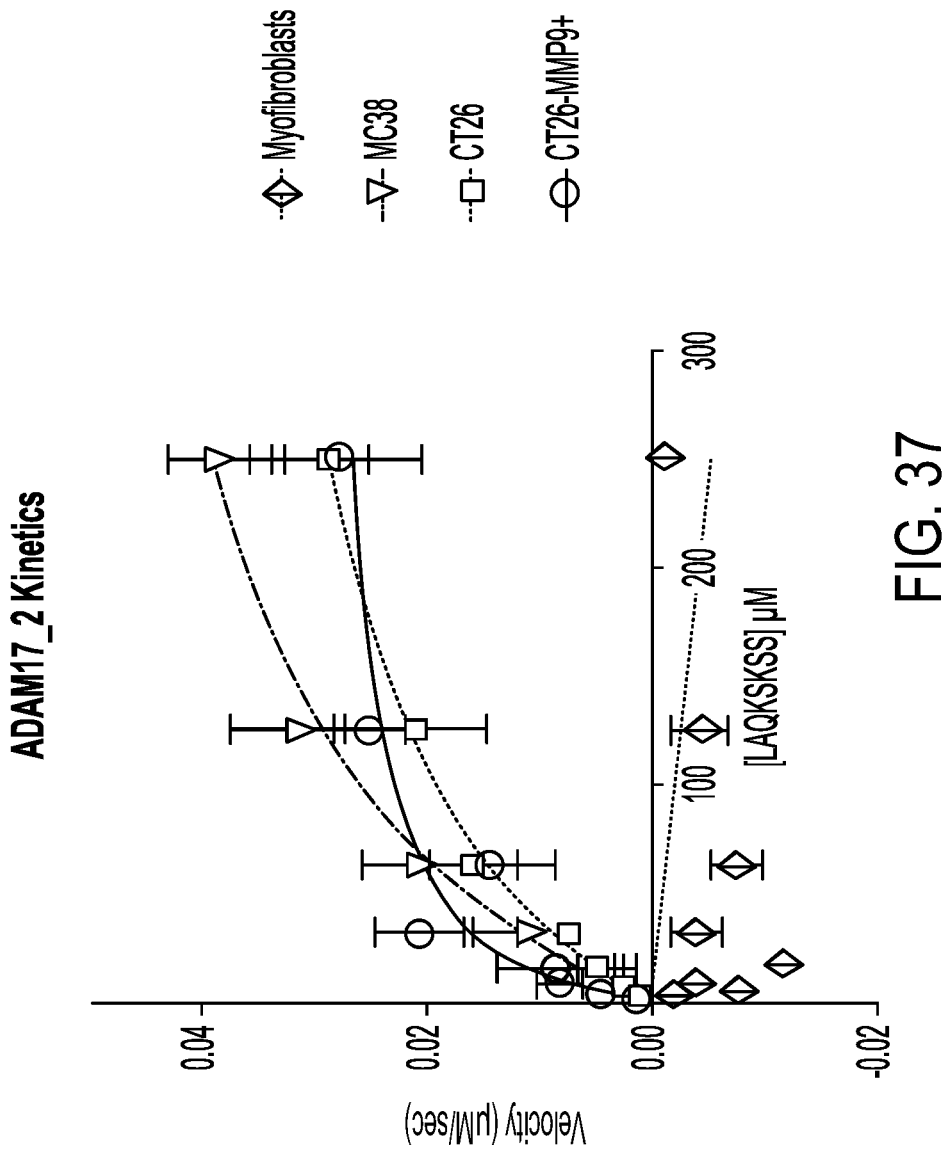

FIG. 37 is a schematic illustrating ADAM17_2 substrate kinetics in cell culture conditioned media. FIG. 37 discloses SEQ ID NO: 235.

Figure 38:
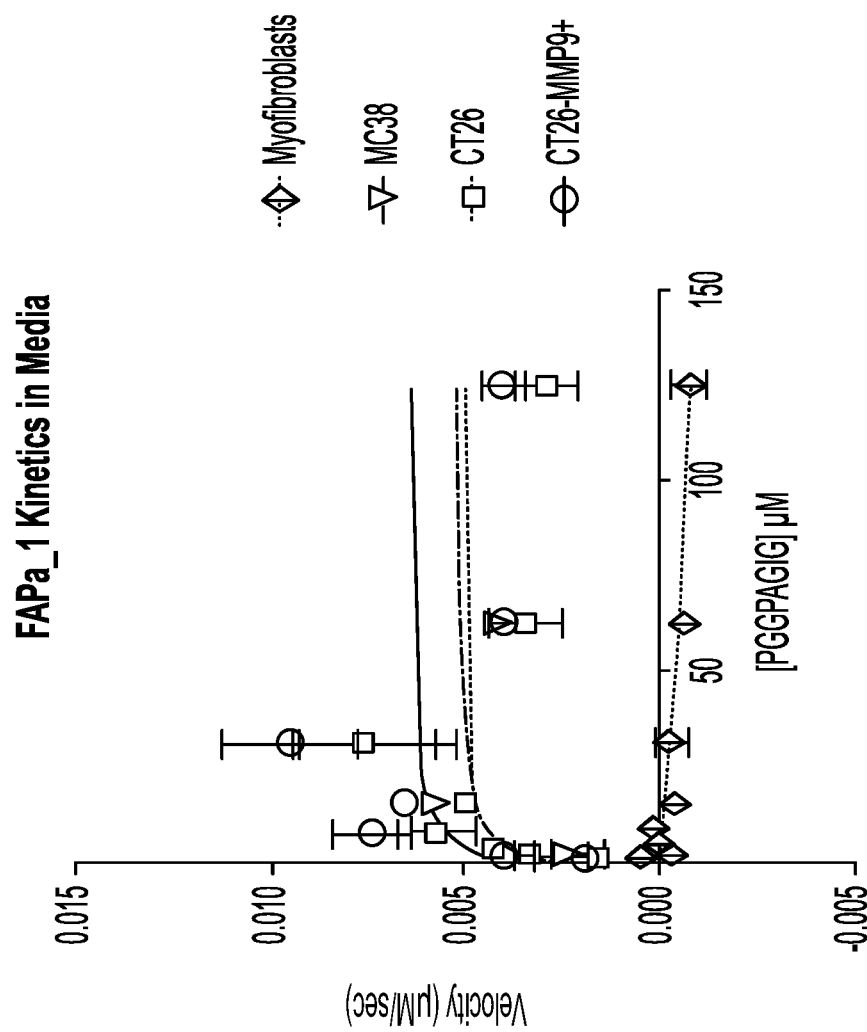

FIG. 38 is a schematic illustrating FAPα_1 substrate kinetics in conditioned media. FIG. 38 discloses SEQ ID NO: 197.

Figure 39:
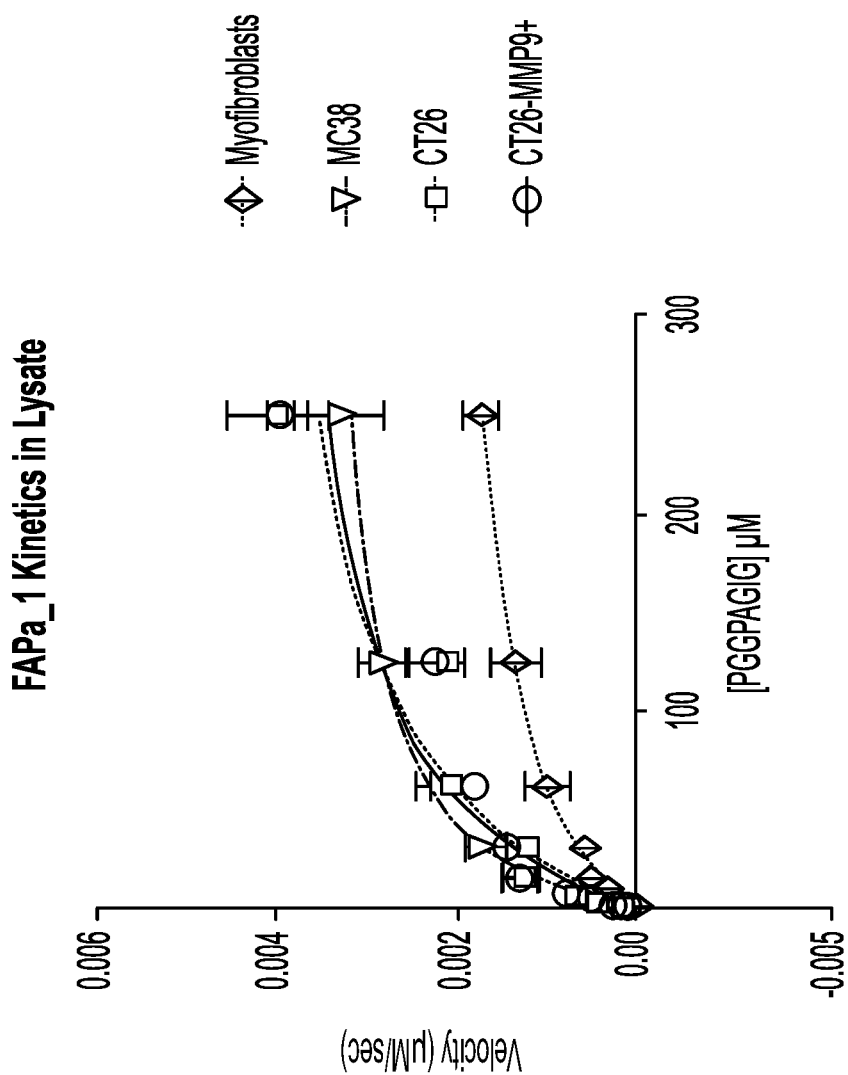

FIG. 39 is a schematic illustrating FAPα_1 substrate kinetics in cell lysates. FIG. 39 discloses SEQ ID NO: 197.

Figure 40:
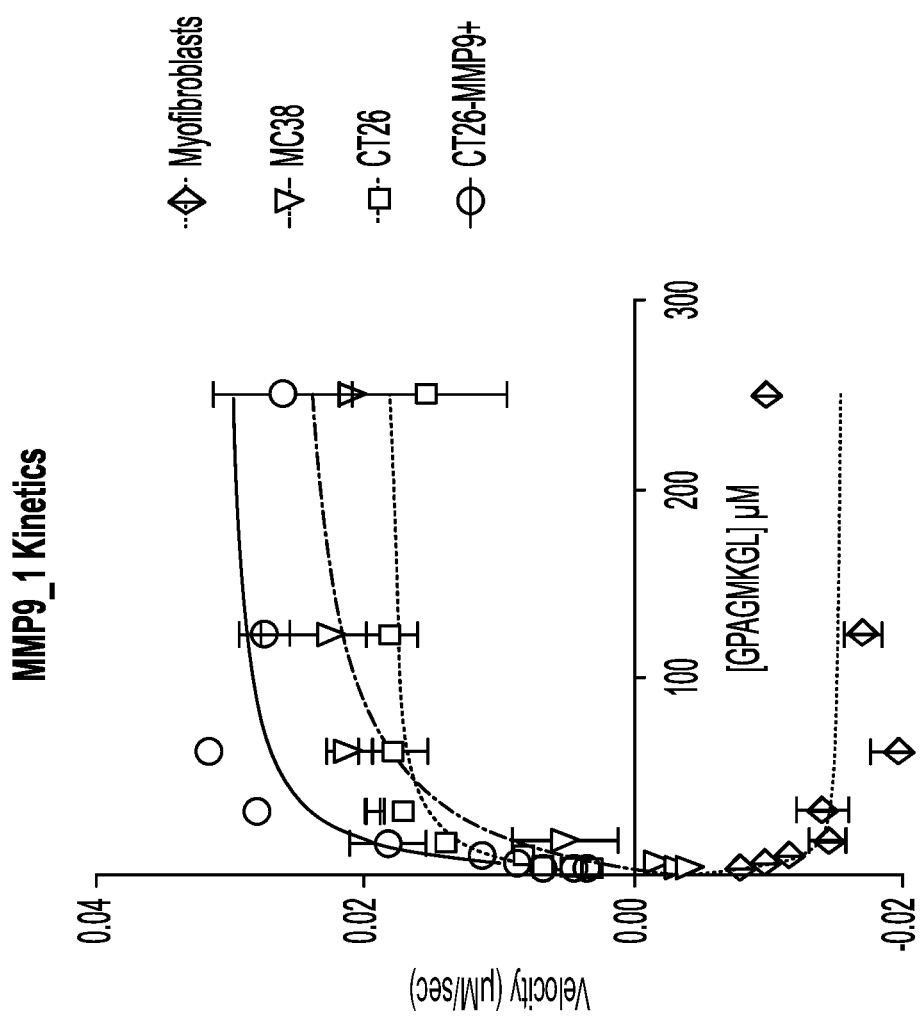

FIG. 40 is a schematic illustrating MMP9_1 substrate kinetics in cell lysates. FIG. 40 discloses SEQ ID NO: 196.

Figure 41:
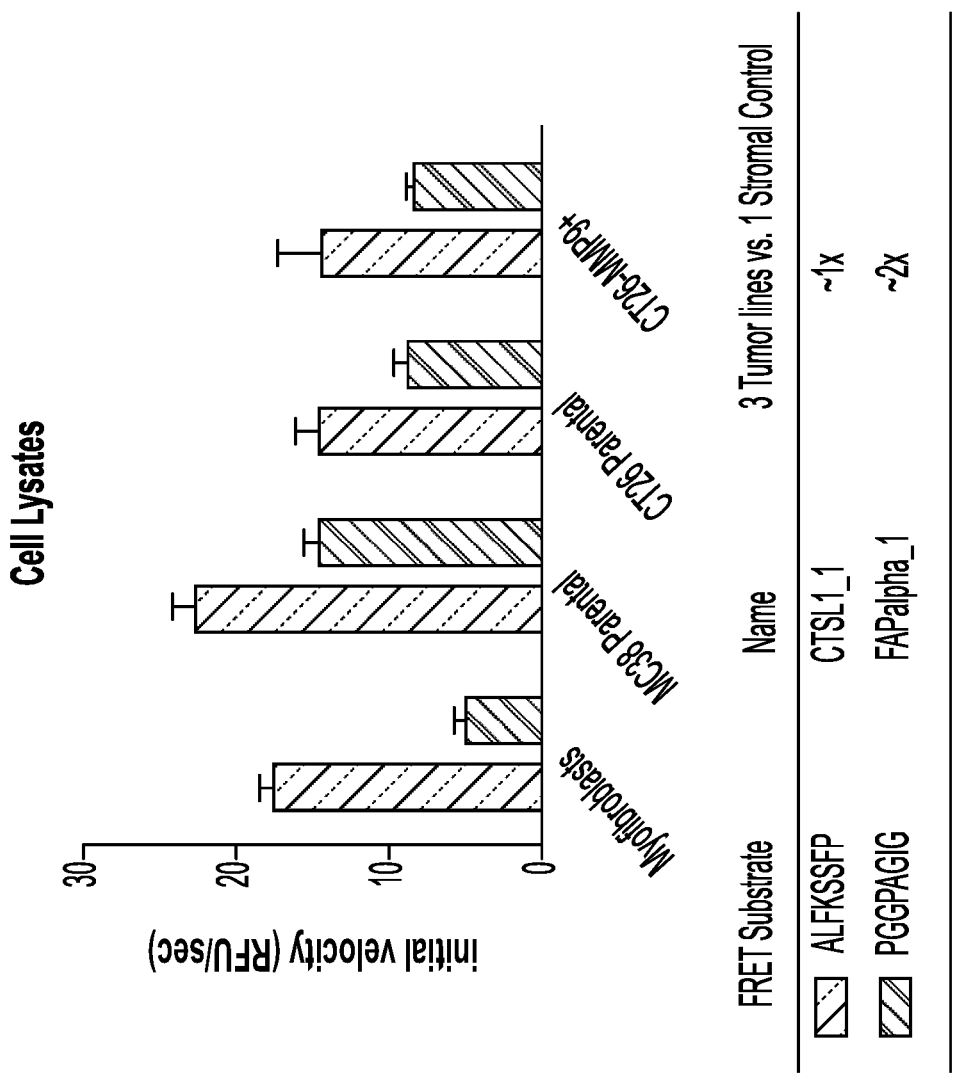

FIG. 41 is a schematic illustrating a substrate cleavage activity in cell lysates by FRET endpoint assay. FIG. 41 discloses SEQ ID NOS 198 and 197, respectively, in order of appearance.

Figure 42:
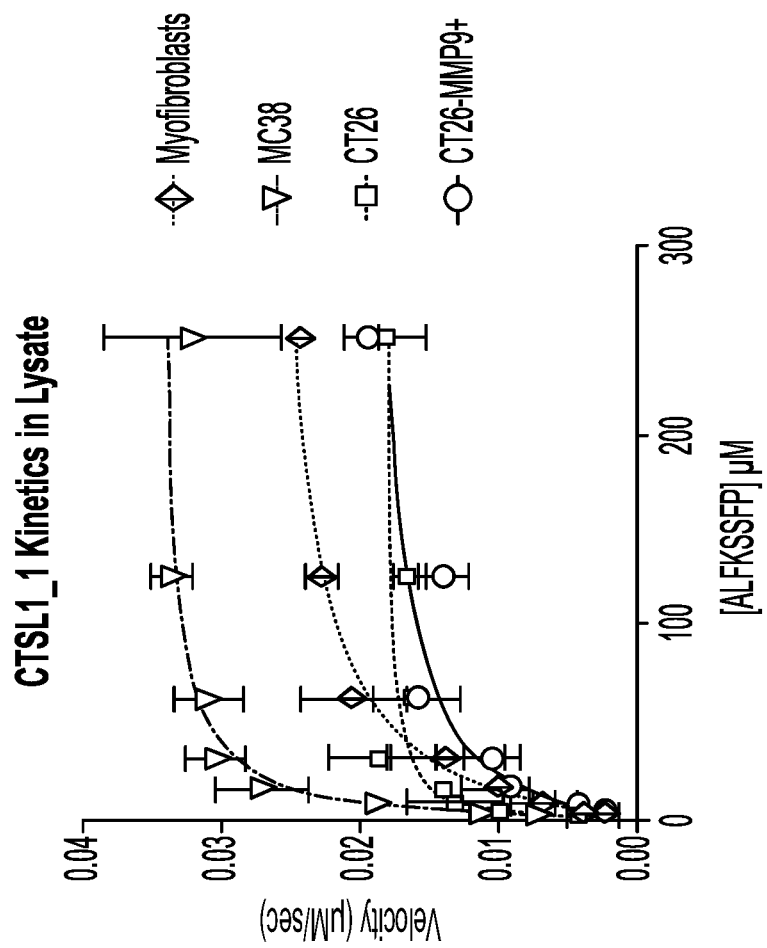

FIG. 42 is a schematic illustrating CTSL1_I substrate kinetics in cell lysates. FIG. 42 discloses SEQ ID NO: 198.

Figure 43:
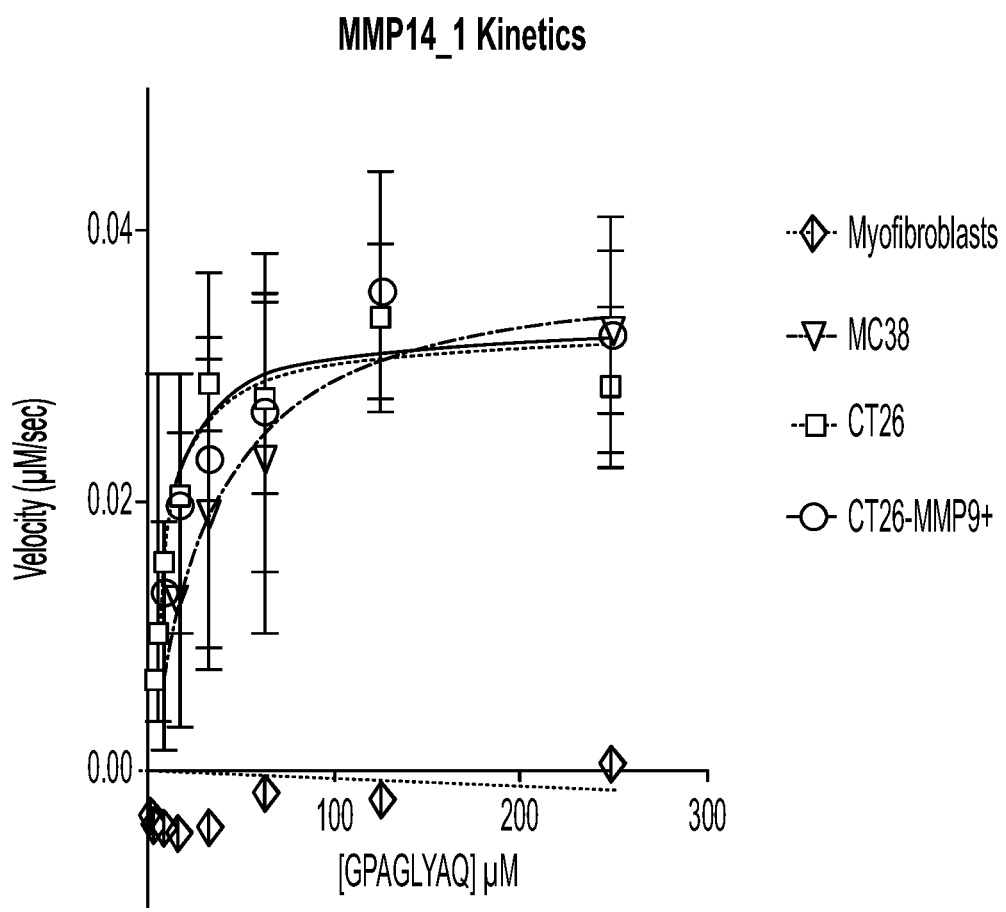

FIG. 43 is a schematic illustrating MMP14_1 substrate kinetics in cell lysates. FIG. 43 discloses SEQ ID NO: 195.

Figure 44:
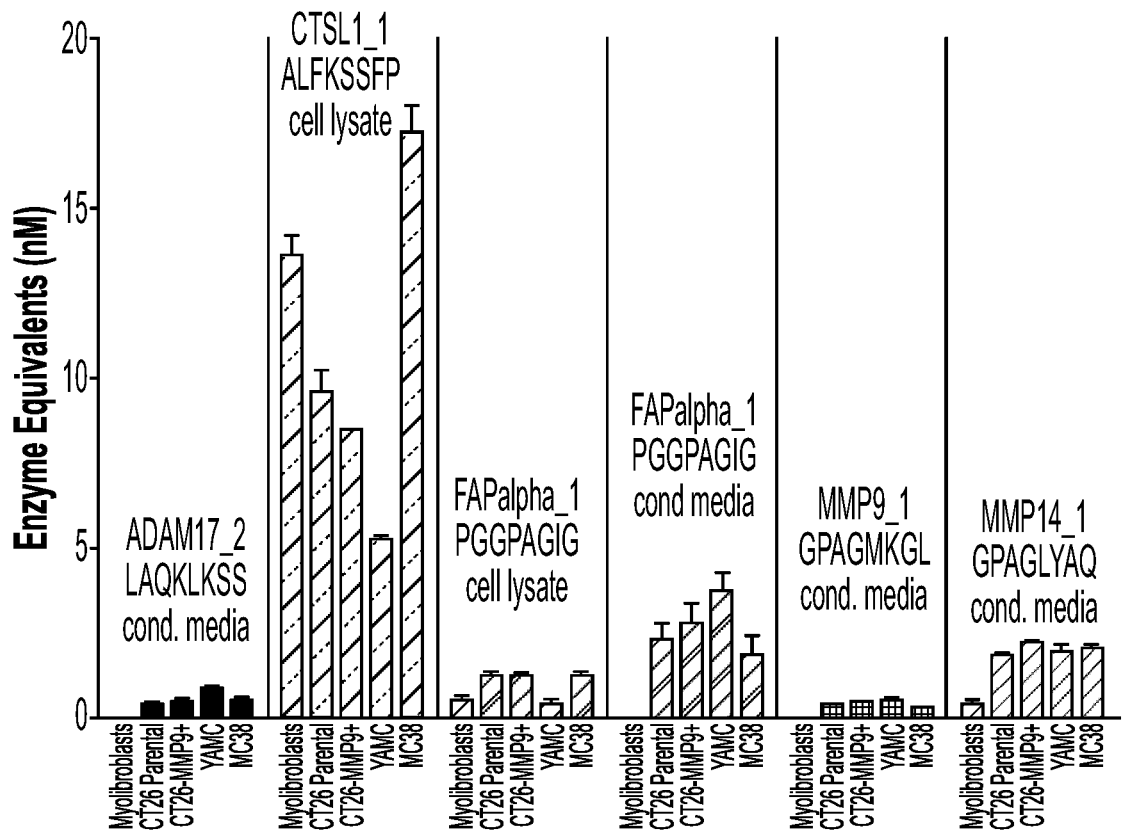

FIG. 44 is a schematic illustrating calculated concentration of enzyme equivalents per cell culture-derived sample. FIG. 44 discloses SEQ ID NOS 201, 198, 197, 197, 196 and 195, respectively, in order of appearance.

Figure 45:
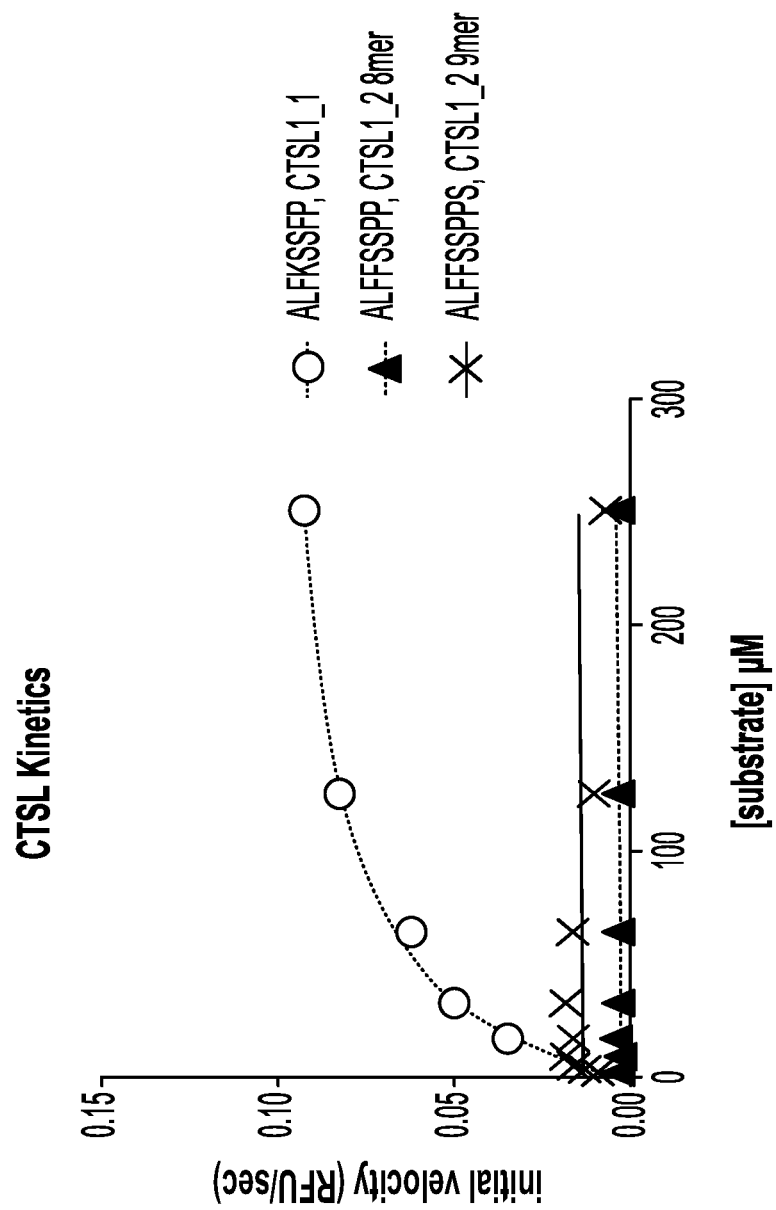

FIG. 45 is a schematic illustrating an enzyme progress curve for CTSL1 cleavage of CSTL1_2 vs CTSL1_1. FIG. 45 discloses SEQ ID NOS 198, 199 and 236, respectively, in order of appearance.

Figure 46B:
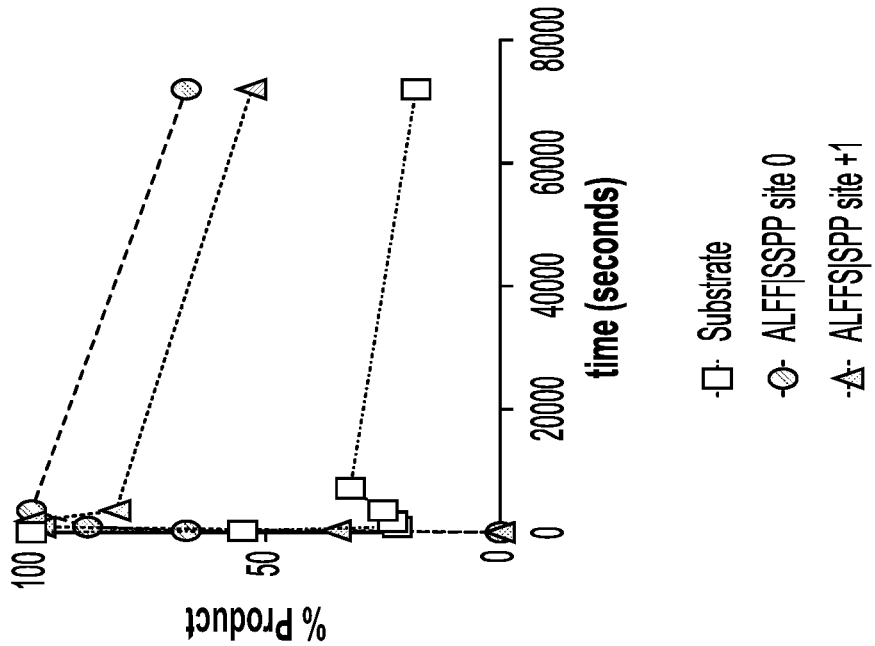
Figure 46A:
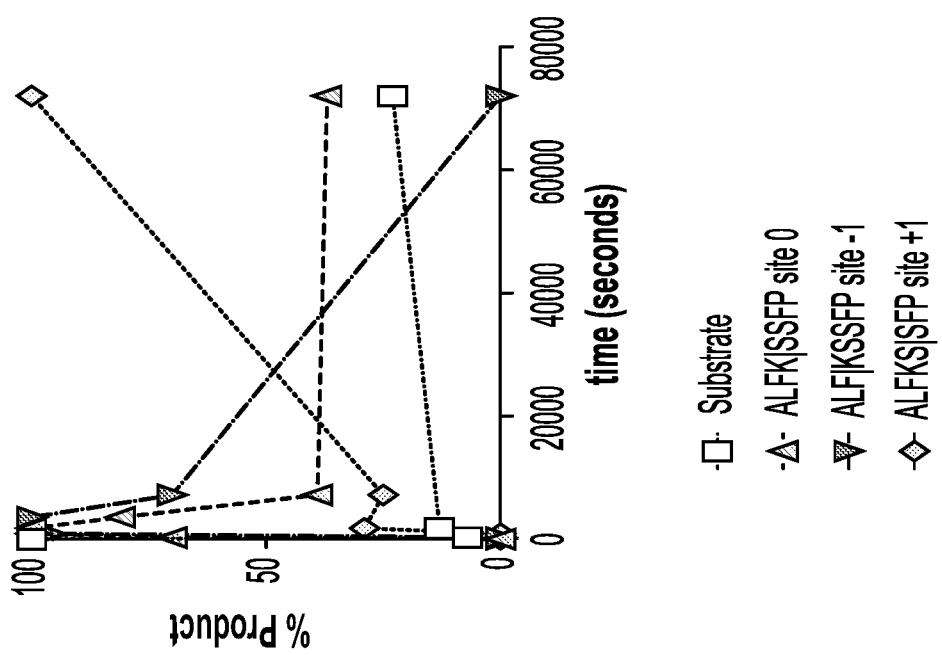

FIG. 46 is a schematic illustrating 30-mer cleavage of CTSL1_1 (ALFKSSFP, SEQ ID NO: 198) vs CTSL1_2 (ALFFSSPP, SEQ ID NO: 199).

Figure 47:
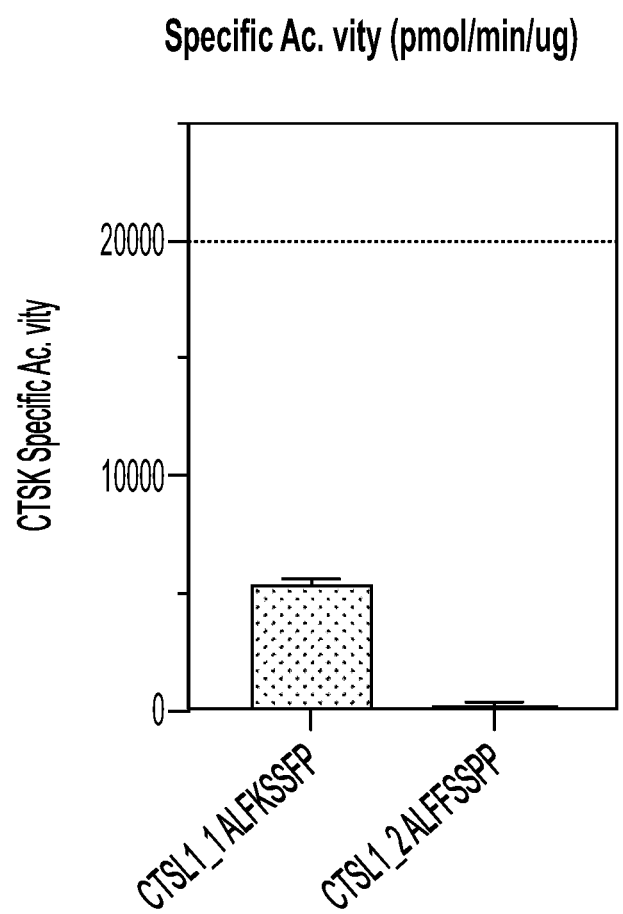

FIG. 47 is a schematic illustrating susceptibility of the CTSL1 FRET substrates to CTSK cleavage. Rates of product formation were measured as a specific activity in units pmol min$^{-1}$ µg$^{-1}$. The threshold value for the reference substrate, Z-LR-AMC is shown as a dashed line. FIG. 47 discloses SEQ ID NOS 198 and 199, respectively, in order of appearance.

Figure 48:
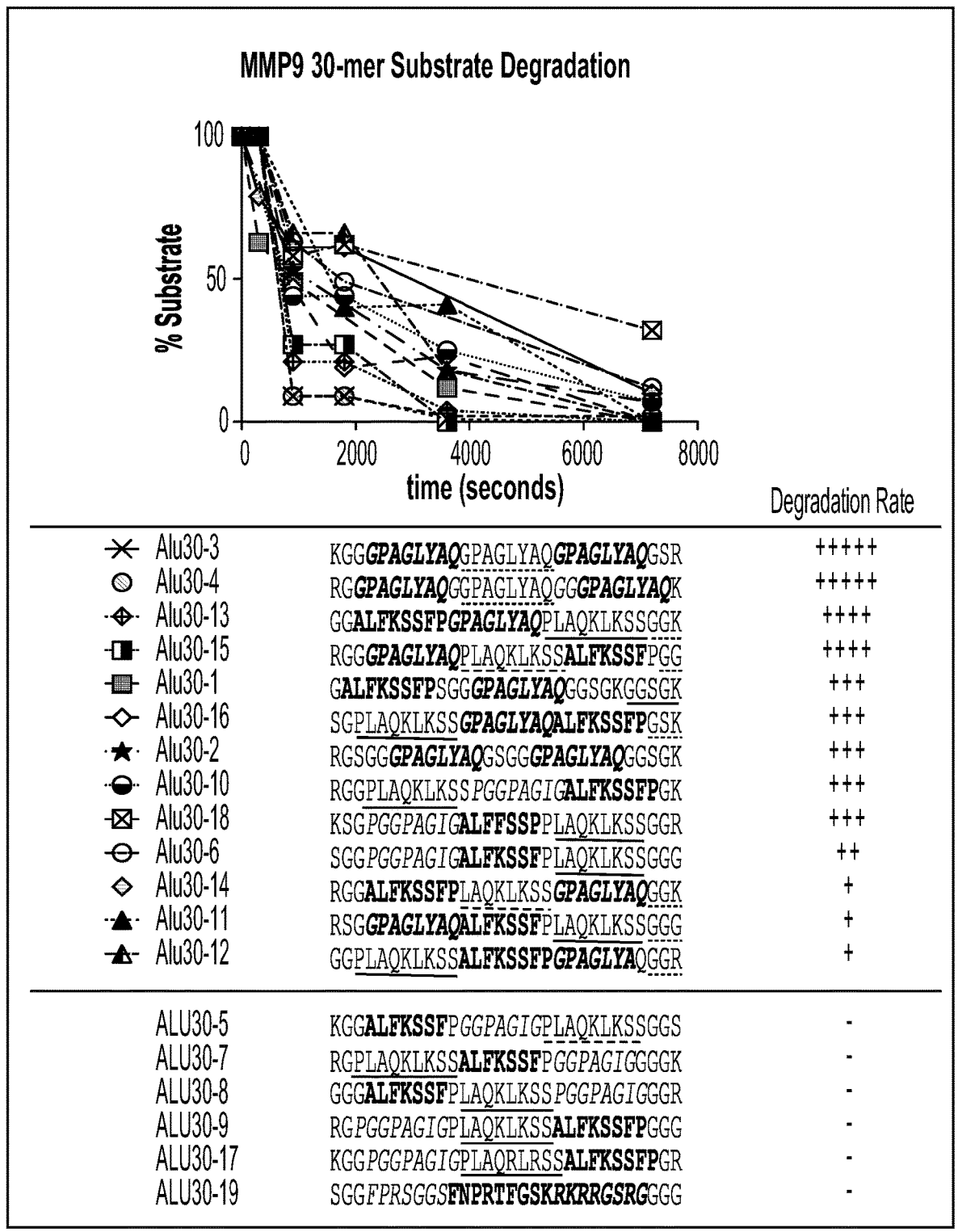

FIG. 48 is a schematic illustrating 30-mer Substrate Degradation by MMP9 Ranking of the substrates by relative rates of degradation are shown with "+"; uncleaved substrates are indicated as "−". FIG. 48 discloses SEQ ID NOS 204, 205, 214, 216, 202, 217, 203, 211, 219, 207, 215, 212, 213, 206, 208, 209, 210, 218 and 220, respectively, in order of appearance.

Figure 49:
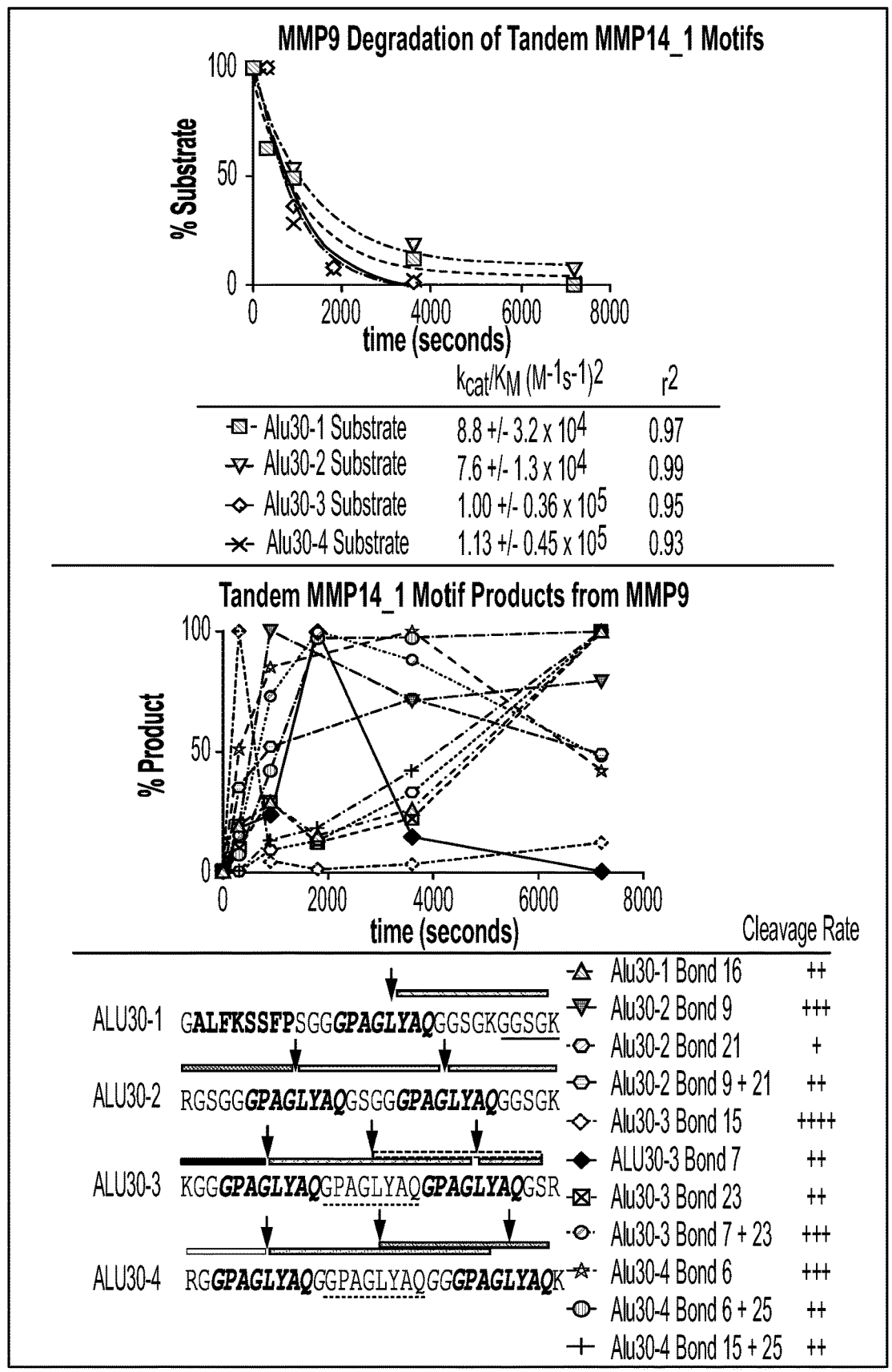

FIG. 49 is a schematic illustrating tandem MMP14_1 Motif degradation by MMP9. Top: substrate degradation traces, modeled with first-order kinetics. Bottom: product formation traces showing complex kinetics. FIG. 49 discloses SEQ ID NOS 202-205, respectively, in order of appearance.

Figure 50:
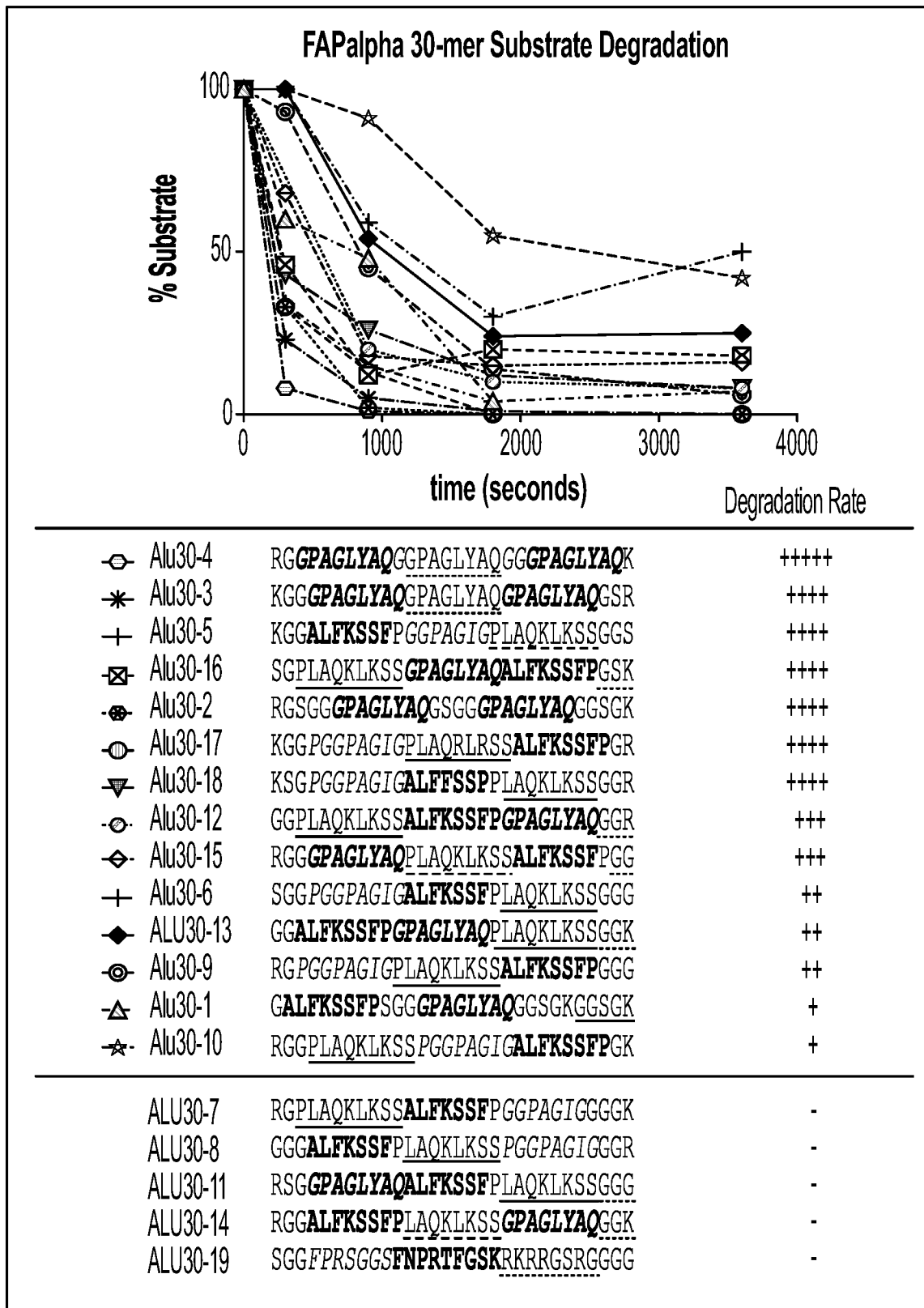

FIG. 50 is a schematic illustrating 30-mer Substrate Degradation by FAPα. Ranking of the substrates by relative rates of degradation are shown with "+"; uncleaved substrates are indicated as "−". FIG. 50 discloses SEQ ID NOS 205, 204, 206, 217, 203, 218, 219, 213, 216, 207, 214, 210, 202, 211, 208, 209, 212, 215 and 220, respectively, in order of appearance.

Figure 51:
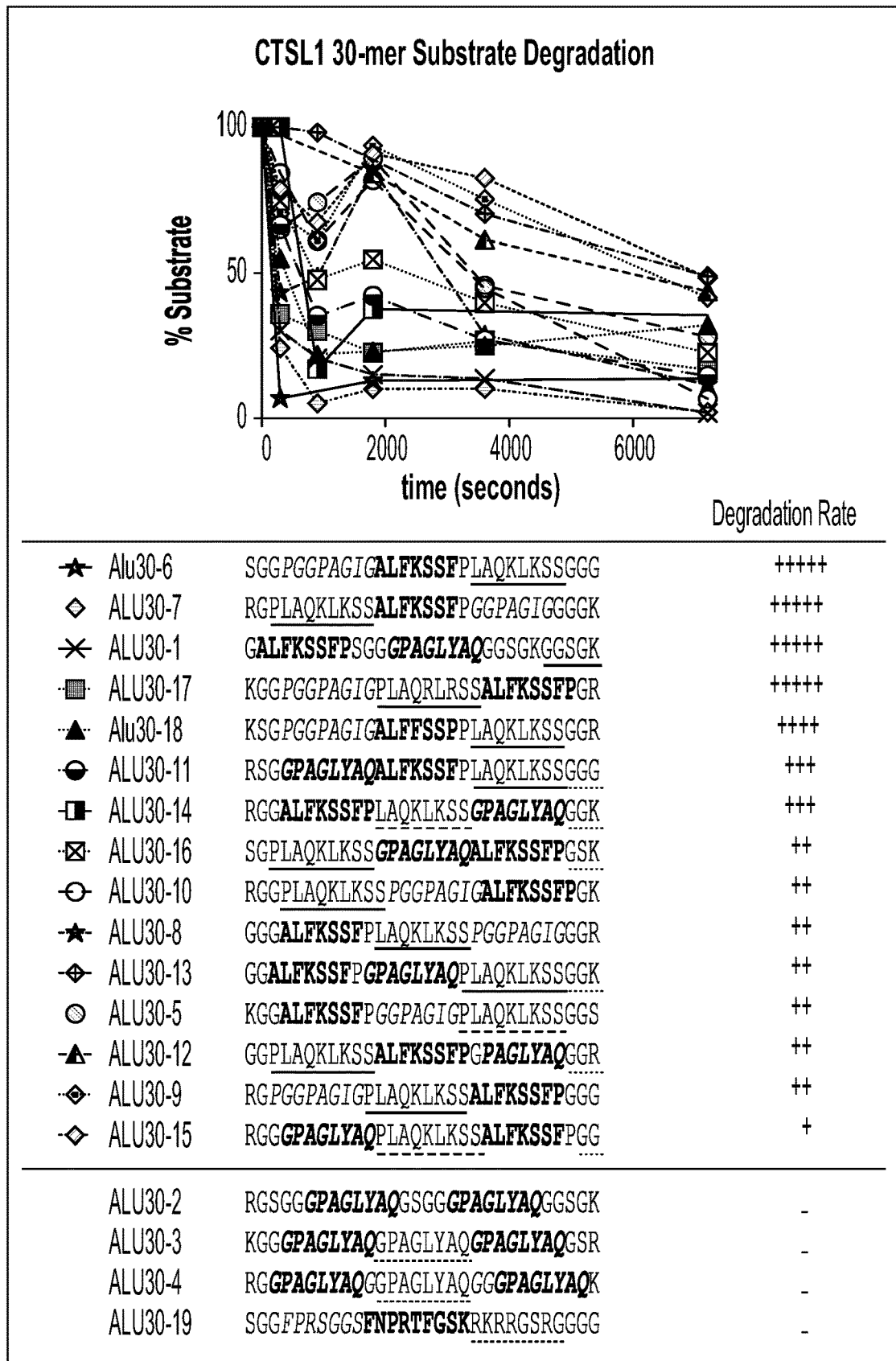

FIG. 51 is a schematic illustrating 30-mer Substrate Degradation by CTSL1 Ranking of the substrates by relative rates of degradation are shown with "+"; uncleaved substrates are indicated as "−". FIG. 51 discloses SEQ ID NOS 207, 208, 202, 218, 219, 212, 215, 217, 211, 209, 214, 206, 213, 210, 216, 203, 204, 205 and 220, respectively, in order of appearance.

Figure 52:
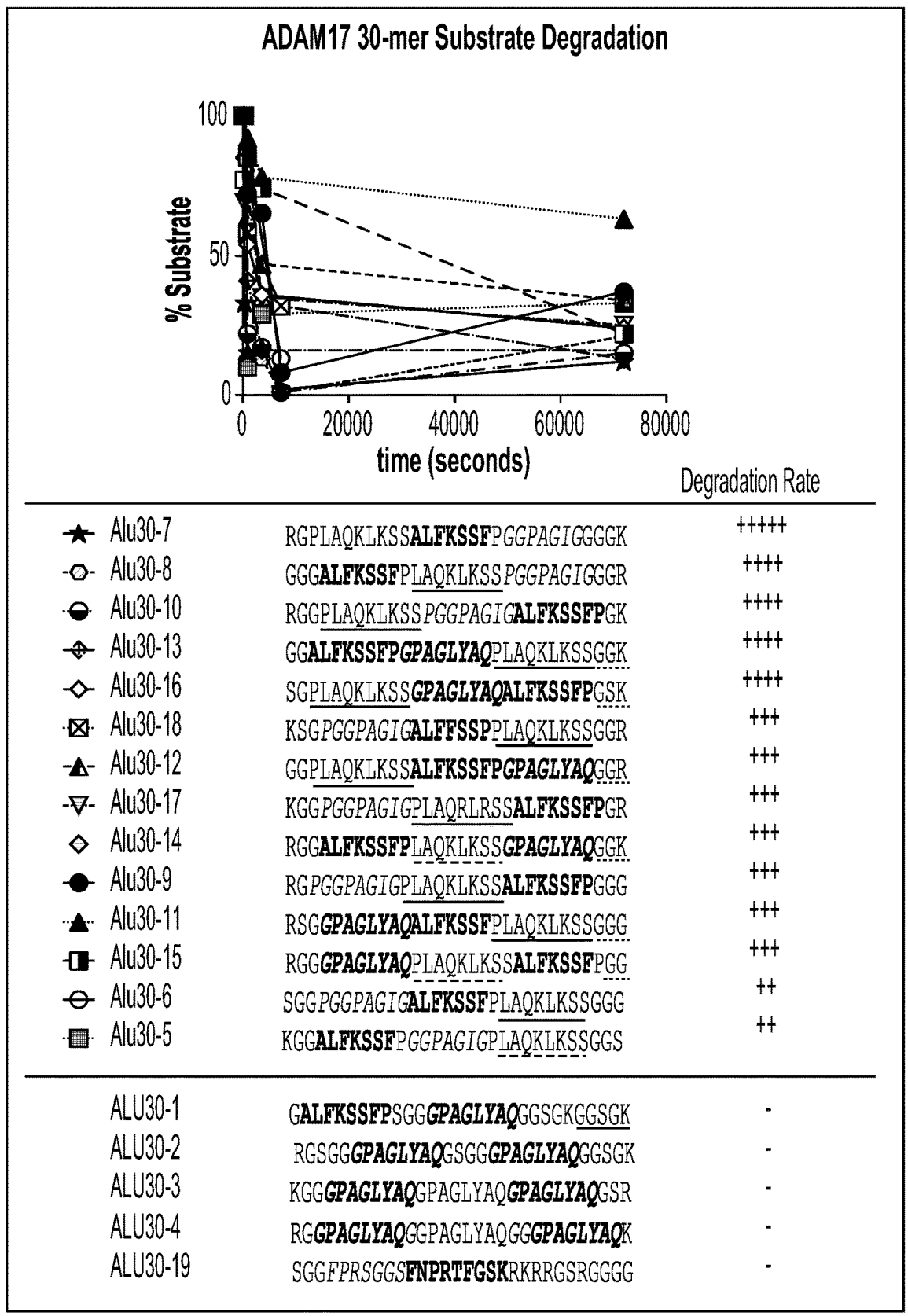

FIG. 52 is a schematic illustrating 30-mer Substrate Degradation by ADAM17 Ranking of the substrates by relative rates of degradation are shown with "+"; uncleaved substrates are indicated as "−". FIG. 52 discloses SEQ ID NOS 208, 209, 211, 214, 217, 219, 213, 218, 215, 210, 212, 216, 207, 206, 202, 203, 204, 205 and 220, respectively, in order of appearance.

Figure 53:
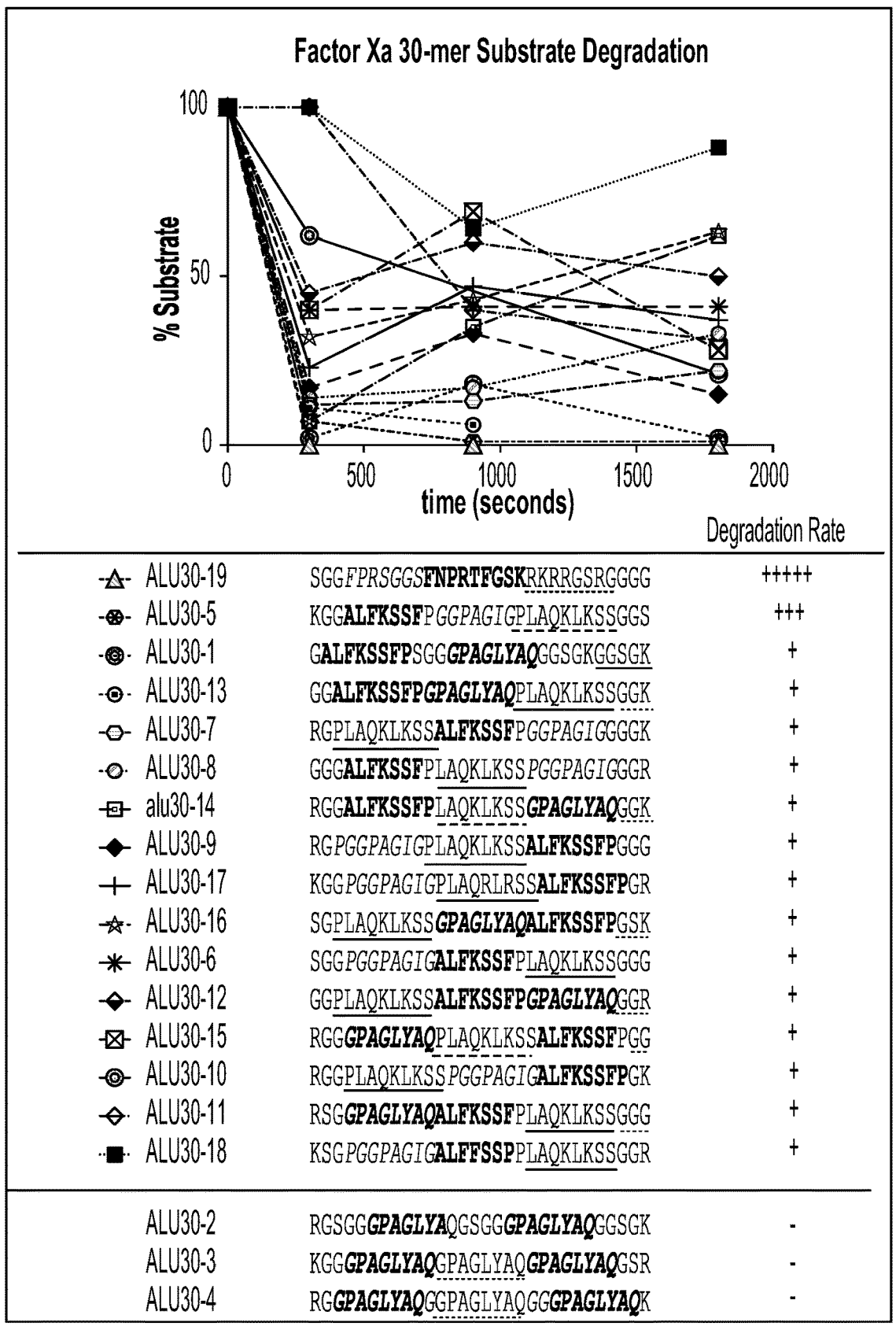

FIG. 53 is a schematic illustrating 30-mer Substrate Degradation by Factor Xa Ranking of the substrates by relative rates of degradation are shown with "+"; uncleaved substrates are indicated as "−". FIG. 53 discloses SEQ ID NOS 220, 206, 202, 214, 208, 209, 215, 210, 218, 217, 207, 213, 216, 211, 212, 219, 203, 204 and 205, respectively, in order of appearance.

Figure 54:
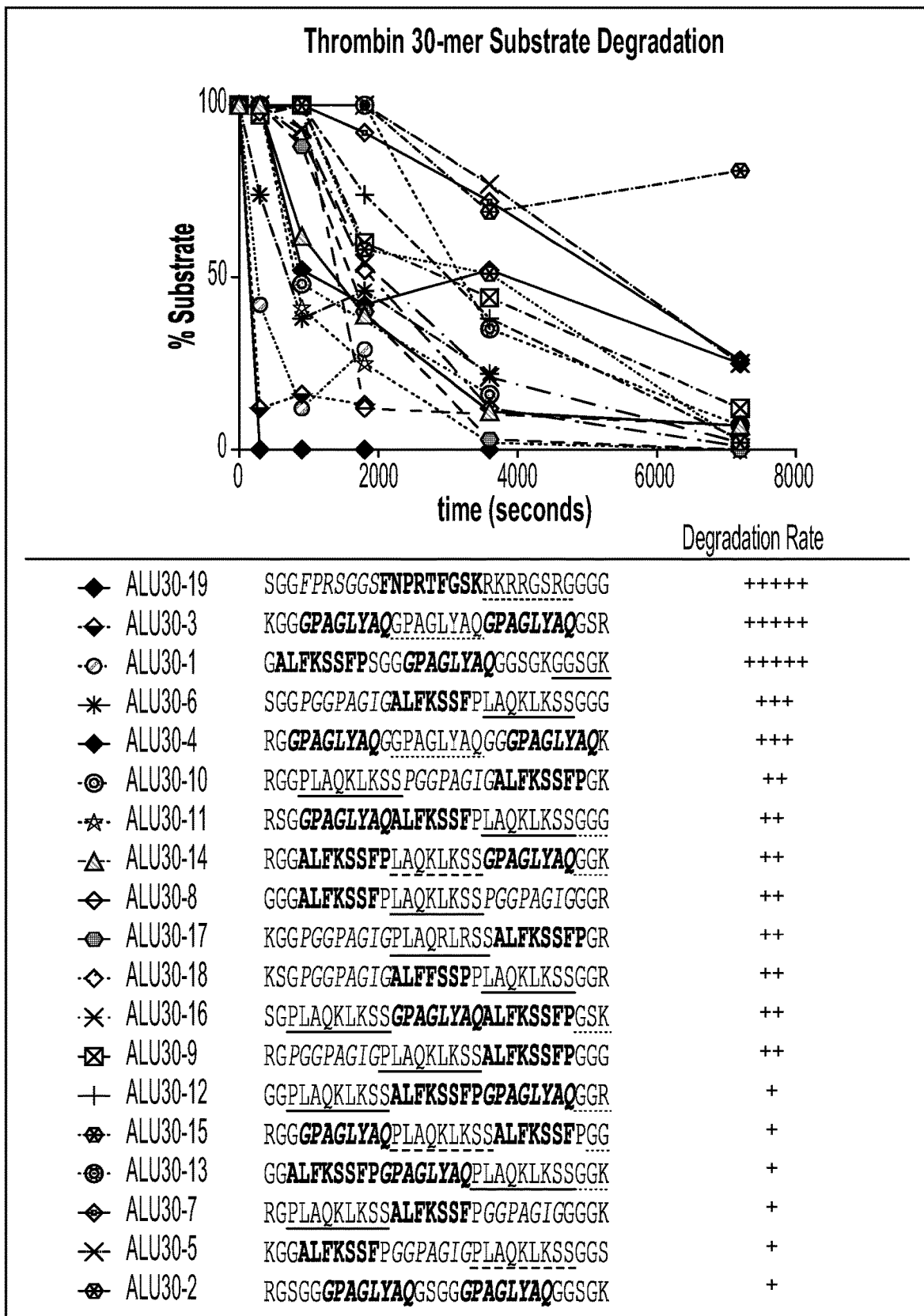

FIG. 54 is a schematic illustrating 30-mer Substrate Degradation by Thrombin Ranking of the substrates by relative rates of degradation are shown with "+"; uncleaved substrates are indicated as "−". FIG. 54 discloses SEQ ID NOS 220, 204, 202, 207, 205, 211, 212, 215, 209, 218, 219, 217, 210, 213, 216, 214, 208, 206 and 203, respectively, in order of appearance.

Figure 55:
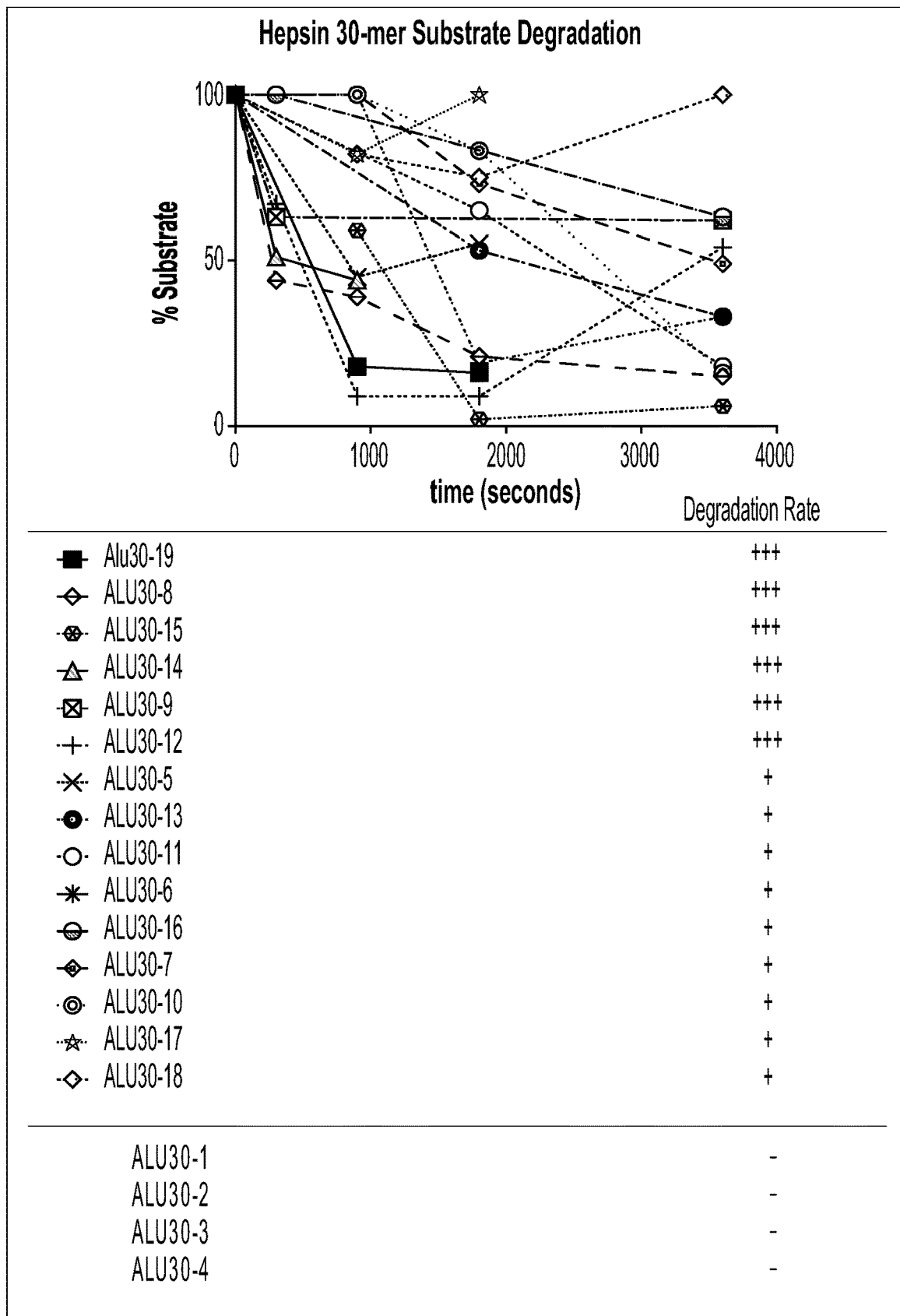

FIG. 55 is a schematic illustrating 30-mer Substrate Degradation by hepsin Ranking of the substrates by relative rates of degradation are shown with "+"; uncleaved substrates are indicated as "−". FIG. 55 discloses SEQ ID NOS 220, 209, 216, 215, 210, 213, 206, 214, 212, 207, 217, 208, 211, 218, 219, 202, 203, 204 and 205, respectively, in order of appearance.

Figure 56B:
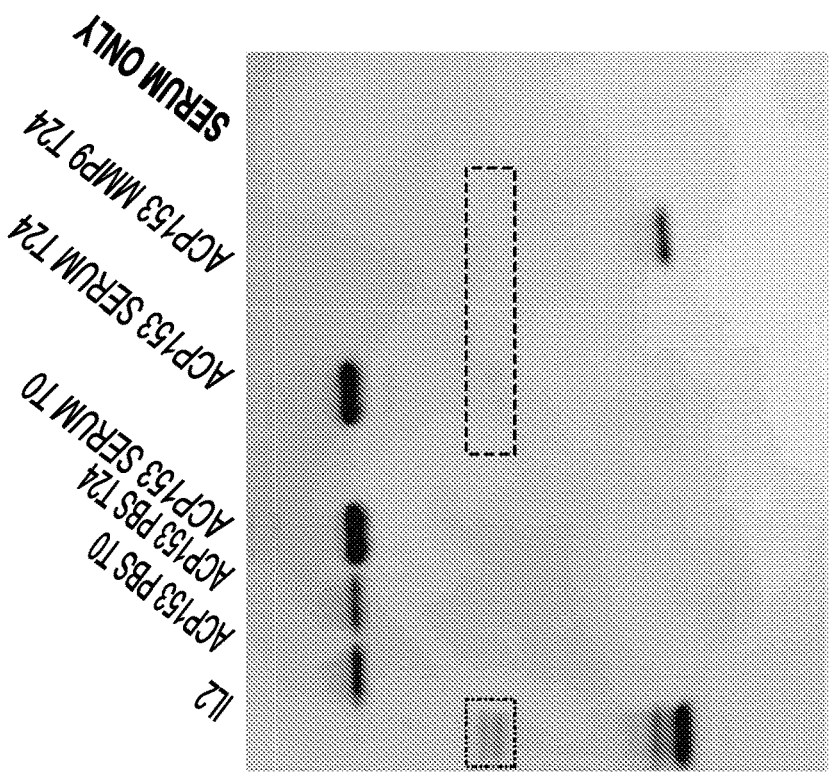
Figure 56A:
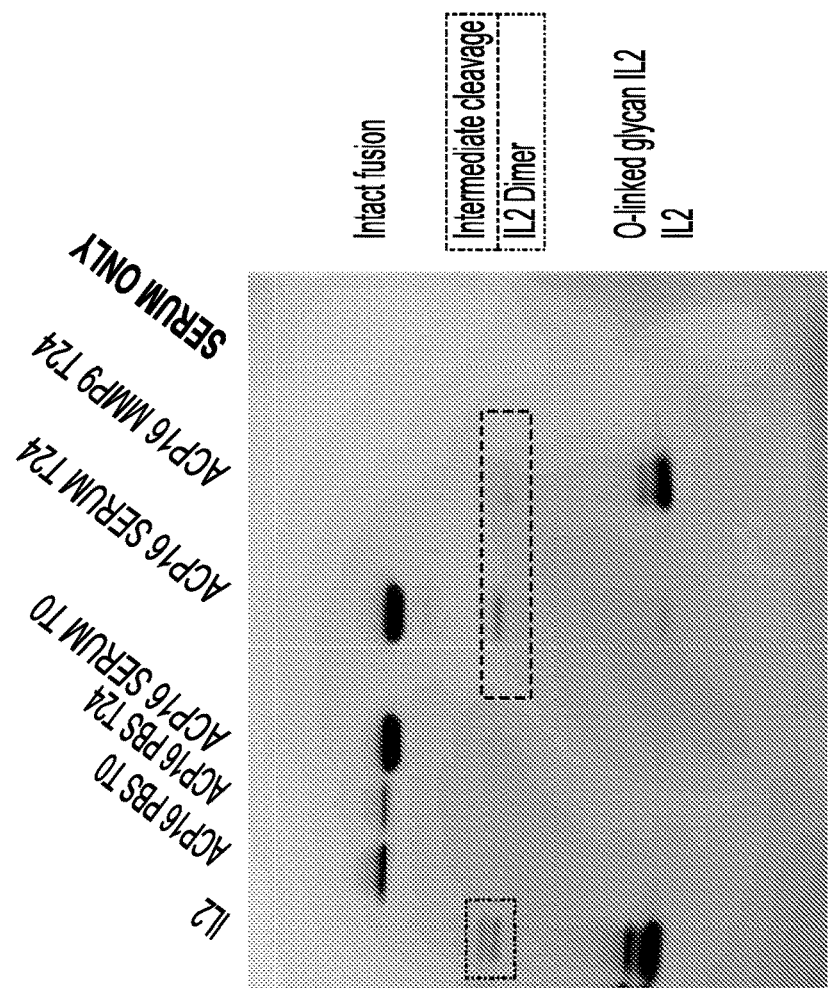
Figure 56C:
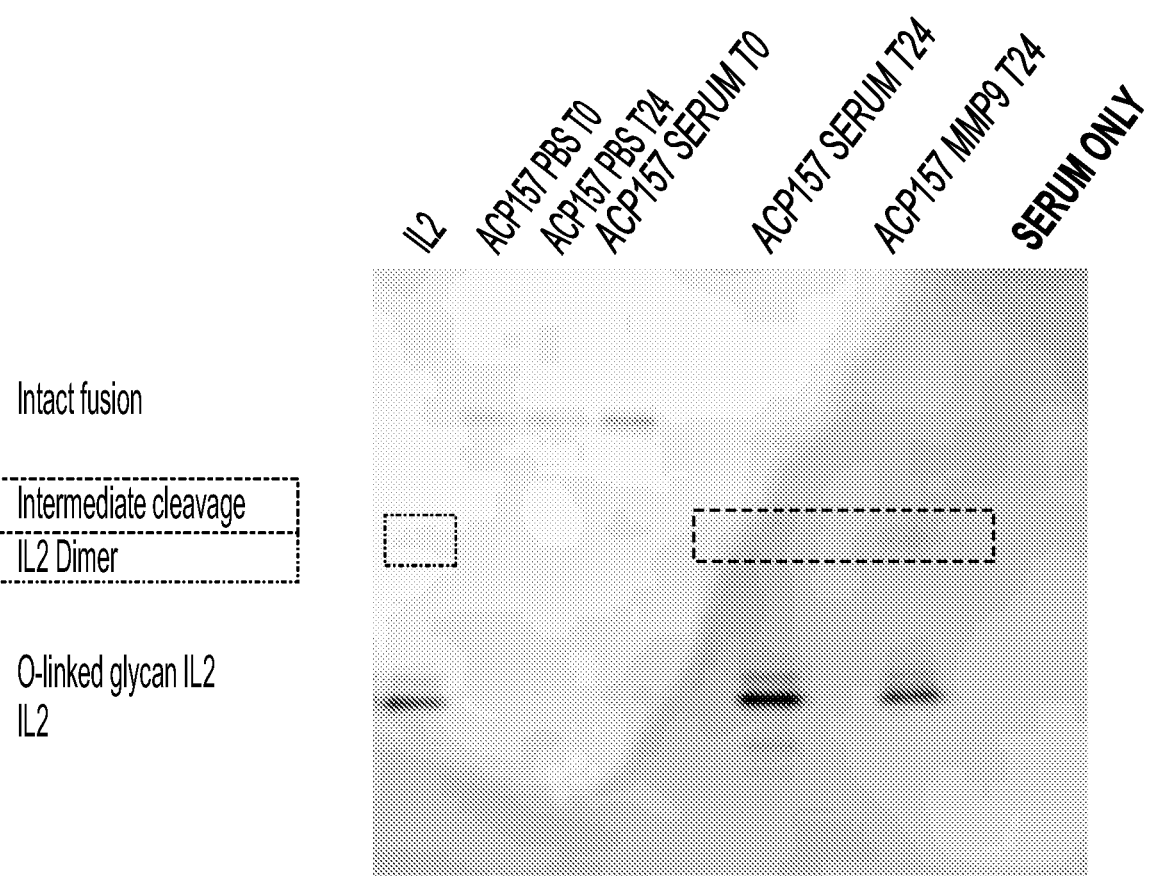

FIGS. 56A-56C show western blots probed with an IL-2 antibody demonstrating the stability of ACP16 (FIG. 56A), ACP153(FIG. 56B), and ACP157 (FIG. 56C) in 90% serum. Serum was pooled from three human donors. Constructs of interest were incubated with PBS, Serum, or MMP9 protease and cleavage was assessed at T=0 hours and at T=24 hours.

Figures 57A, 57B:
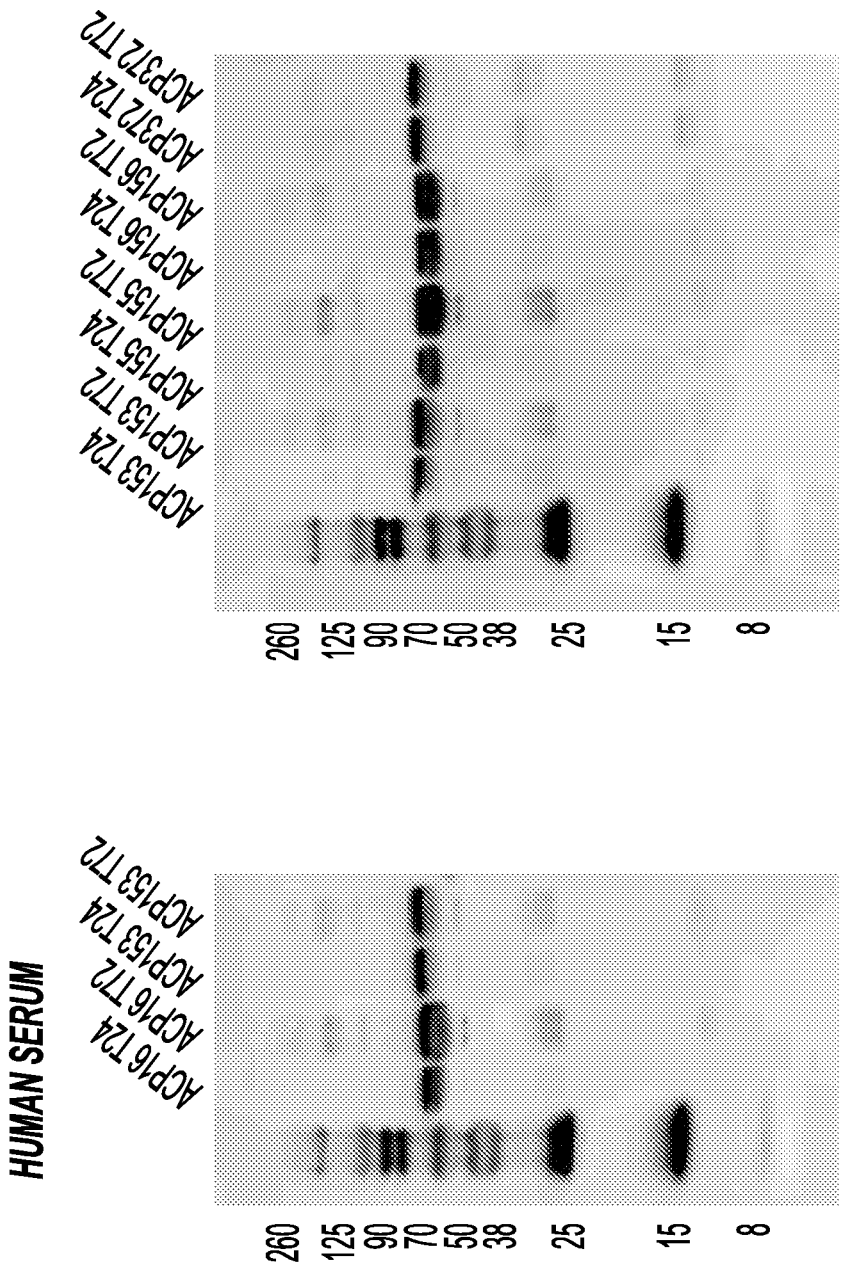
Figures 57C, 57D:
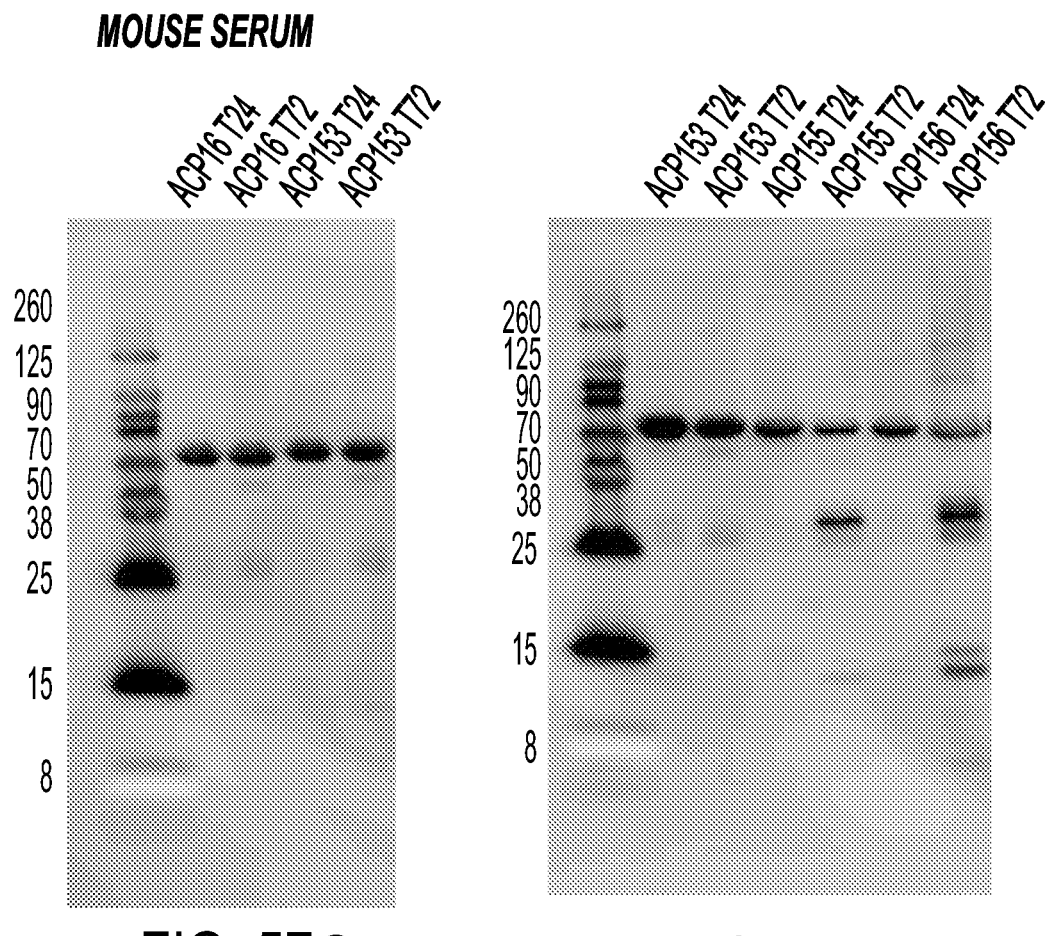

FIG. 57A-57D show western blots probed with an IL-2 antibody demonstrating the stability of ACP153, ACP155, ACP156, ACP16, and ACP372 in 90% serum. Serum was pooled from three human donors. Constructs of interest were incubated with PBS, Serum, or MMP9 protease and cleavage was assessed at T=24 hours and at T=72 hours. FIGS. 57A-57B shows the result using serum from a human donor and FIGS. 57C-57D shows the result using serum from a mouse donor.

Figure 58A:
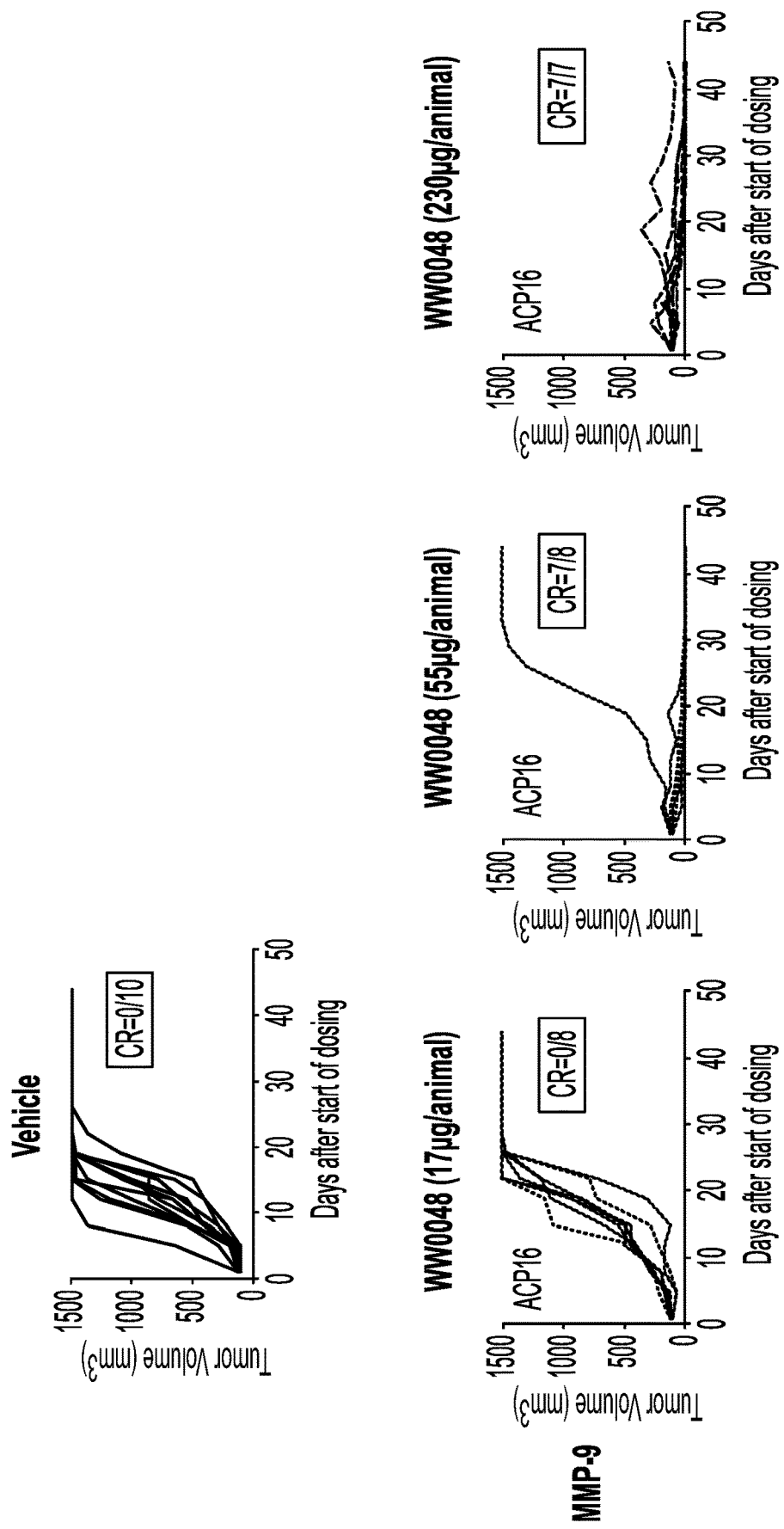
Figure 58D:
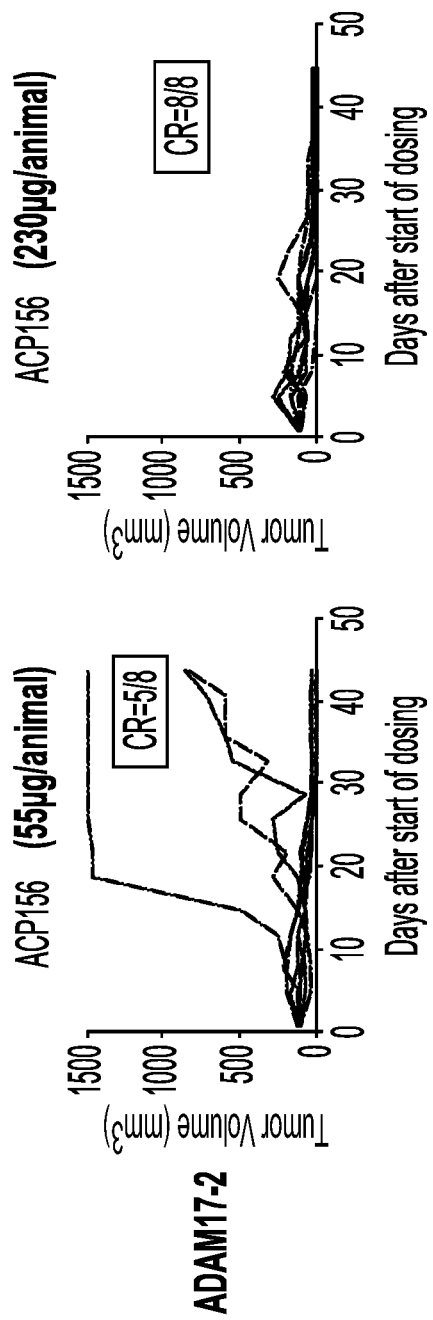
Figure 59:
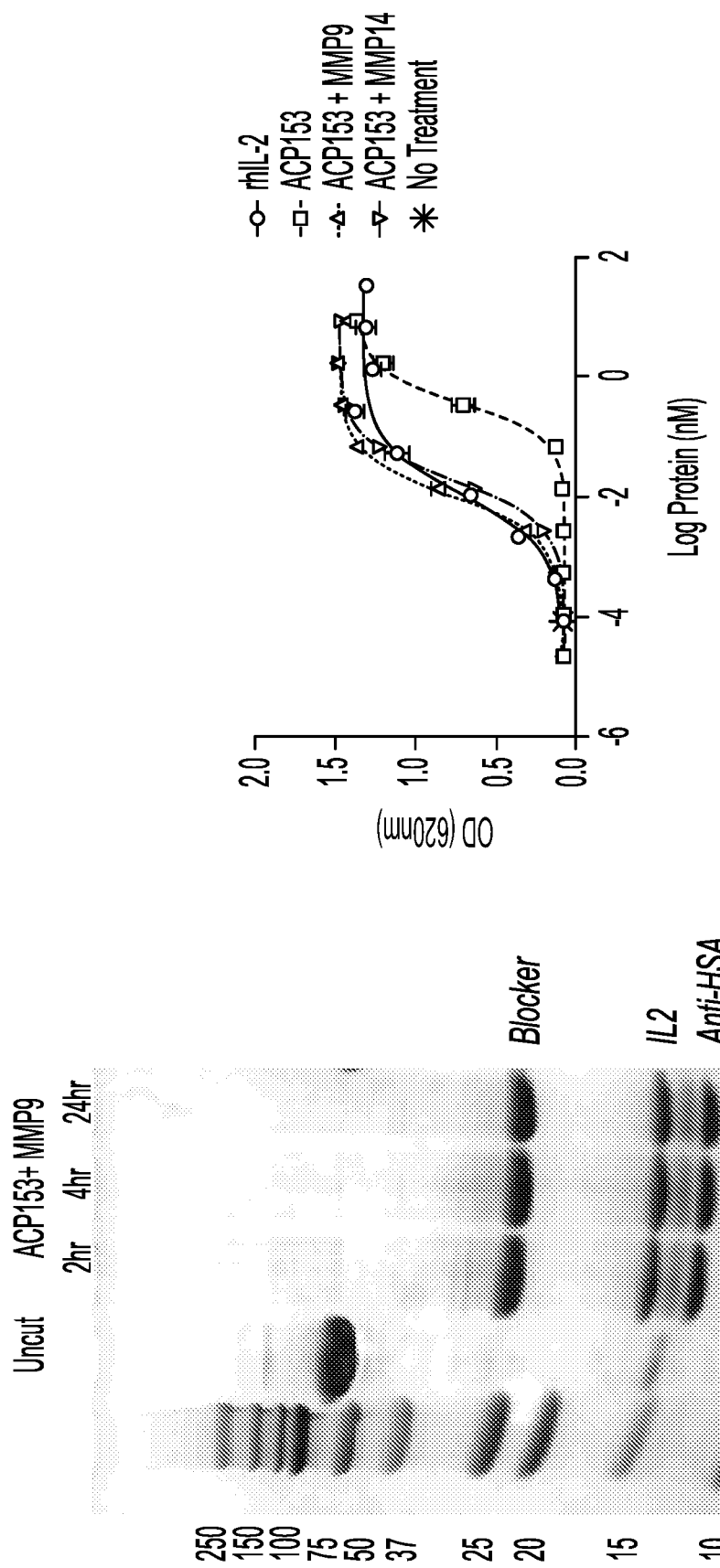

FIGS. 58A-58D show a series of spaghetti plots showing activity of fusion proteins in an MC38 mouse xenograft model. Shown are vehicle alone (FIG. 58A, top), 17, 55, and 230 µg ACP16 (FIG. 58A), 55 and 230 µg ACP153 (FIG. 58B), 55 and 230 µg ACP155 (FIG. 58C), and 55 and 230 µg ACP156 (FIG. 58D). Each line in the plots represents an individual animal FIG. 59 shows a graph depicting results from a STAT activation reporter assay performed on IL-2 fusion proteins and recombinant human IL2 (Rec hIL-2). Analysis was performed based on quantification of Secreted Alkaline Phosphatase (SEAP) activity using the reagent QUANTI-Blue (InvivoGen).

Figure 60:
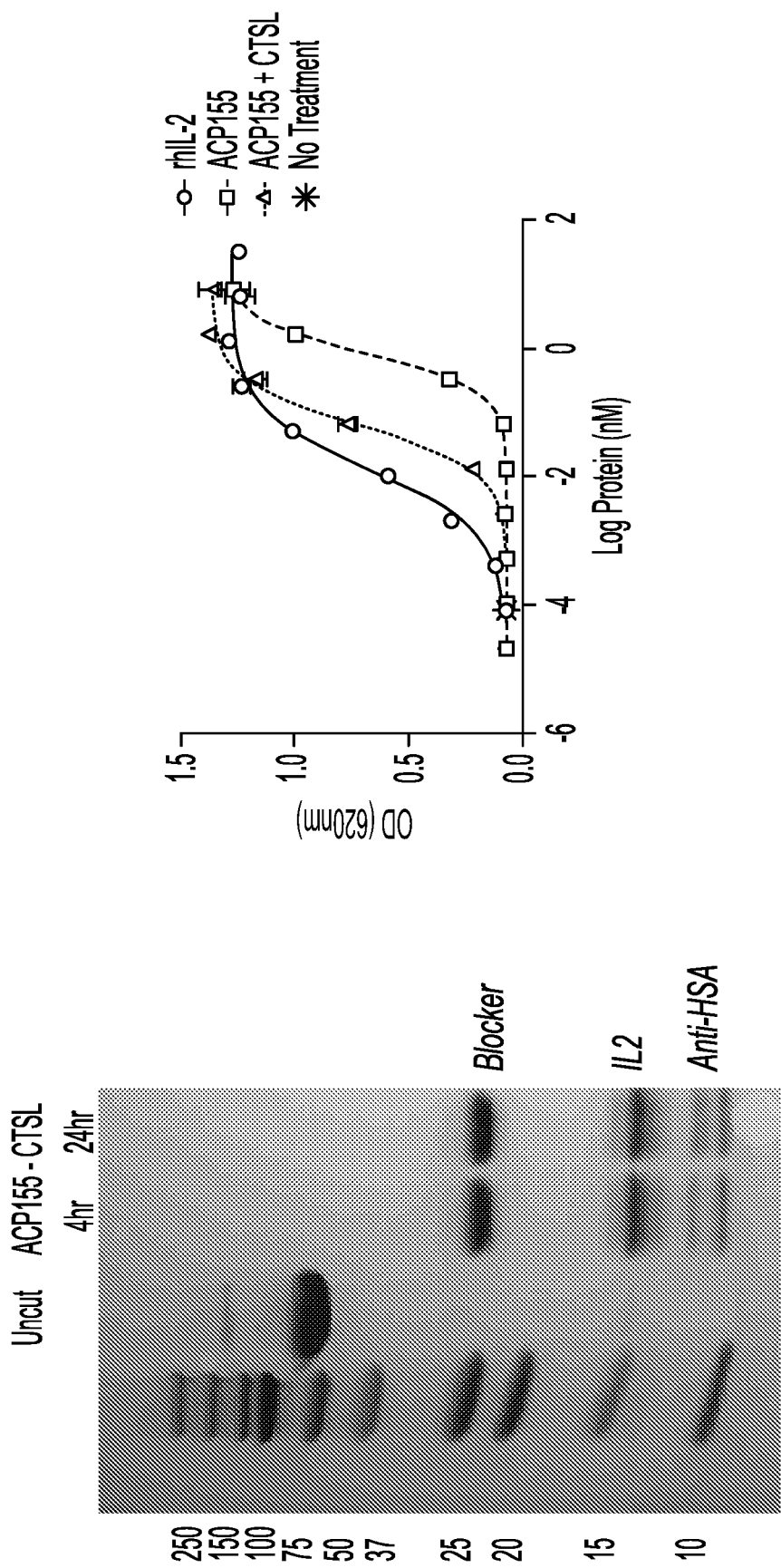

FIG. 60 shows a graph depicting results from a STAT activation reporter assay performed on IL-2 fusion proteins and recombinant human IL2 (Rec hIL-2). Analysis was performed based on quantification of Secreted Alkaline Phosphatase (SEAP) activity using the reagent QUANTI-Blue (InvivoGen).

FIG. 61 shows a graph depicting results from a STAT activation reporter assay performed on IL-2 fusion proteins and recombinant human IL2 (Rec hIL-2). Analysis was performed based on quantification of Secreted Alkaline Phosphatase (SEAP) activity using the reagent QUANTI-Blue (InvivoGen).

Figure 62A:
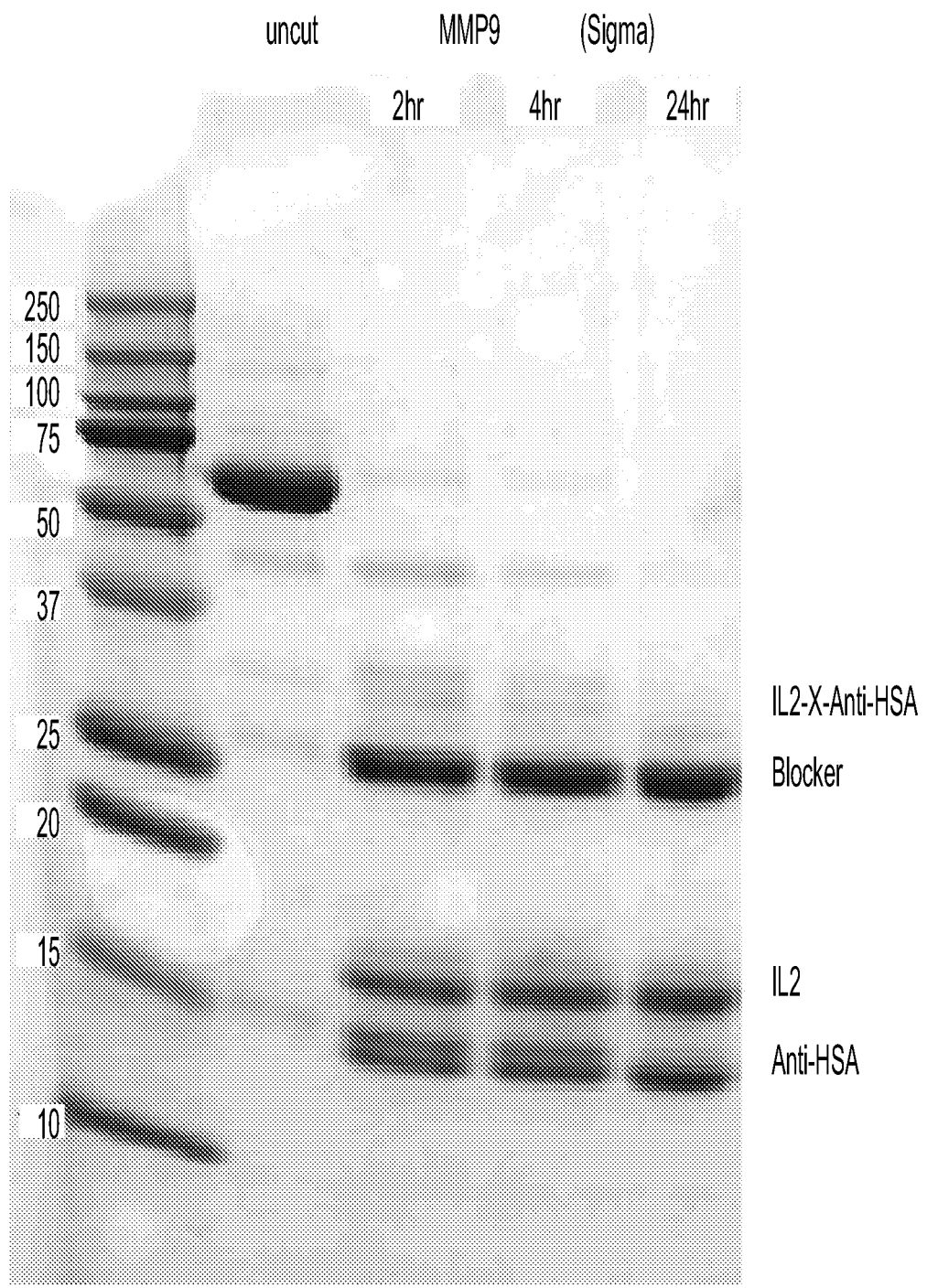
Figure 62B:
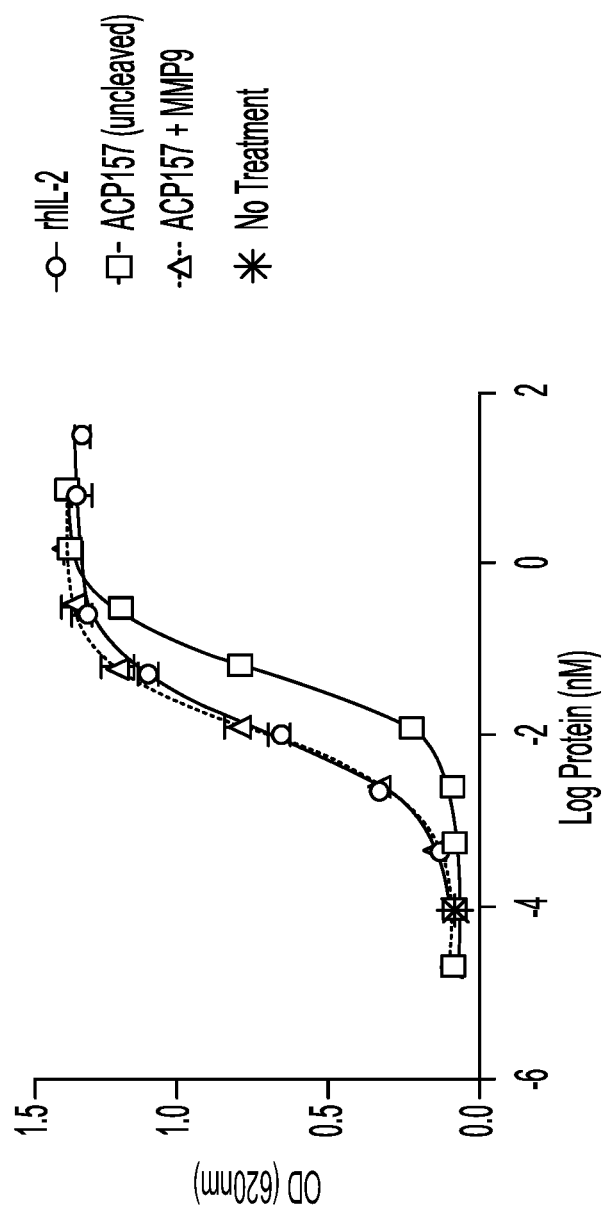

FIG. 62B shows a graph depicting results from a STAT activation reporter assay performed on IL-2 fusion proteins and recombinant human IL2 (Rec hIL-2). Analysis was performed based on quantification of Secreted Alkaline Phosphatase (SEAP) activity using the reagent QUANTI-Blue (InvivoGen). FIG. 62A shows an SDS-PAGE gel of construct cleavage by MMP9 protease.

FIGS. 63A-63B shows tables reporting engineered cleavage substrates described herein and the extent of cleavage observed using relevant proteases Flanking sequences are lower case, the first cleavable sequence is underlined, the second is in bold font, and the third cleavable sequence is in italics. In some cases, there is overlap between cleavable sequences, which are indicated accordingly. FIGS. 63A-63B discloses SEQ ID NOS 202-220, respectively, in order of appearance.

FIG. 64 is a schematic of an inducible tetravalent antibody format.

Figure 65A:
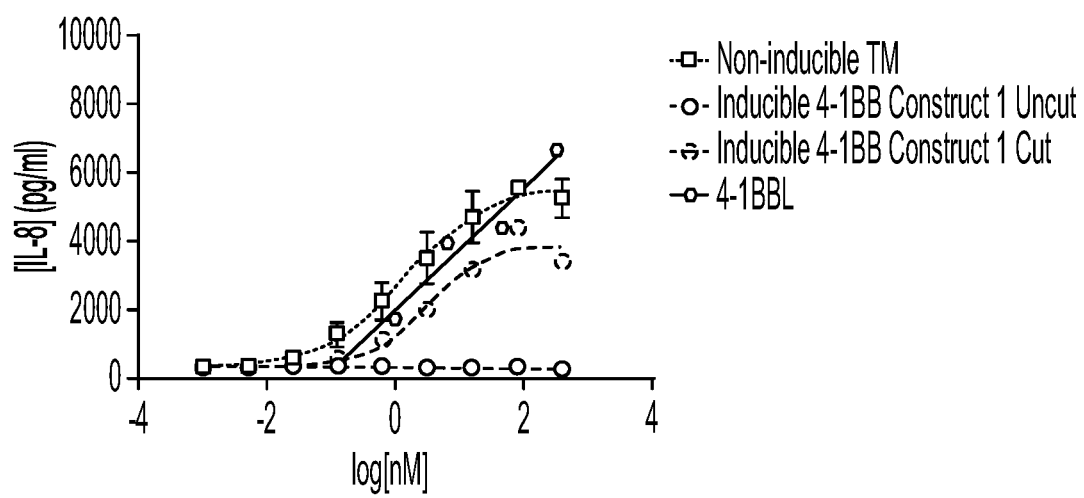
Figure 65B:
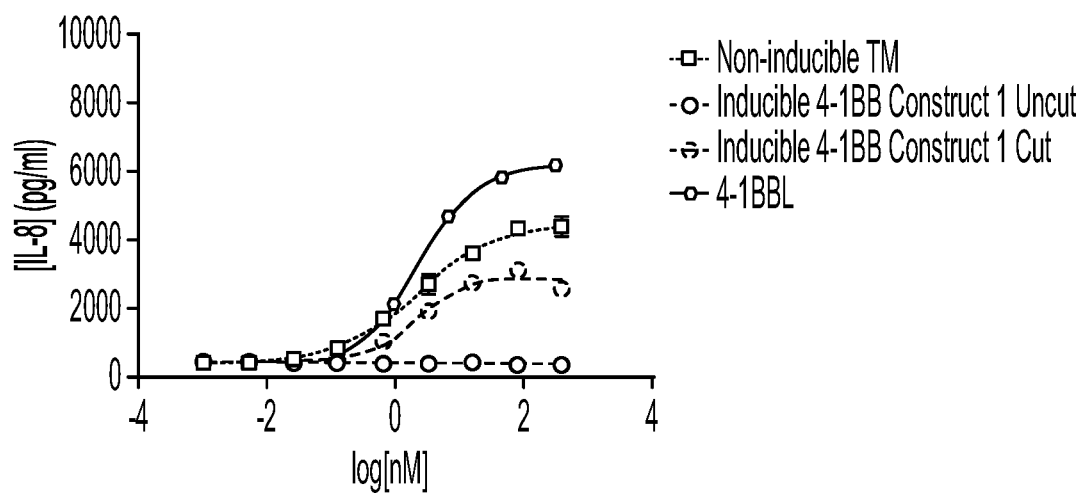

FIGS. 65A-65B show that multivalent 4-1BB antibodies are able to inducibly agonize 4-1BB.

5. DETAILED DESCRIPTION

This disclosure relates to novel separation moieties or linkers and to polypeptides, such as fusion proteins, that contain the linkers. The linkers are preferably protease cleavable and link a first amino acid sequence of interest (e.g. a first domain of interest) to a second amino acid sequence of interest (e.g. a second domain of interest).

The disclosed separation moieties confer site-selectivity with regard to the action of the attached payload or payloads. The payload can be a therapeutic agent, a half-life extender, a blocking agent and the like, or any combination thereof. The separation moieties may be used to attach any payload of interest, including e.g. cytokines, antibodies, cell-based therapies, etc. The separation moieties may be used individually or be used in tandem, triplicate, quadruplicate, and so forth, as long as the separation moiety is smaller than about 100 amino acids. Individual separation moieties may be directly joined to each other, or may be interspersed with non-cleavable linkers, whichever promotes high efficiency and site-specificity.

The various embodiments of the present disclosure are further described in detail in the paragraphs below.

Unless otherwise defined, all terms of art, notations and other scientific terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a difference over what is generally understood in the art. The techniques and procedures described or referenced herein are generally well understood and commonly employed using conventional methodologies by those skilled in the art, such as, for example, the widely utilized molecular cloning methodologies described in Sambrook et al., *Molecular Cloning: A Laboratory Manual* 4th ed. (2012) Cold Spring Harbor Laboratory Press, Cold Spring Harbor, N.Y. As appropriate, procedures involving the use of commercially available kits and reagents are generally carried out in accordance with manufacturer-defined protocols and conditions unless otherwise noted.

"Cytokine" is a well-known term of art that refers to any of a class of immunoregulatory proteins (such as interleukin or interferon) that are secreted by cells especially of the immune system and that are modulators of the immune system. Cytokine polypeptides that can be used in the fusion proteins disclosed herein include, but are not limited to, transforming growth factors, such as TGF-α and TGF-β (e.g., TGFbeta1, TGFbeta2, TGFbeta3); interferons, such as interferon-α, interferon-β, interferon-γ, interferon-kappa and interferon-omega; interleukins, such as IL-1, IL-1α, IL-2, IL-3, IL-4, IL-5, IL-6, IL-7, IL-8, IL-9, IL-10, IL-11, IL-12, IL-13, IL-14, IL-15, IL-16, IL-17, IL-18, IL-21 and IL-25; tumor necrosis factors, such as tumor necrosis factor alpha and lymphotoxin; transforming growth factor beta (TGFbeta) family proteins, chemokines (e.g., C-X-C motif chemokine 10 (CXCL10), CCL19, CCL20, CCL21), and granulocyte macrophage-colony stimulating factor (GM-CS), as well as fragments of such polypeptides that active the cognate receptors for the cytokine (i.e., functional fragments of the foregoing). "Chemokine" is a term of art that refers to any of a family of small cytokines with the ability to induce directed chemotaxis in nearby responsive cells.

Cytokines are well-known to have short serum half-lives that frequently are only a few minutes. Even forms of cytokines that have altered amino acid sequences intended to extend the serum half-life yet retain receptor agonist activity typically also have short serum half-lives. As used herein, a "short-half-life cytokine" refers to a cytokine that has a substantially brief half-life circulating in the serum of a subject, such as a serum half-life that is less than 10, less than 15, less than 30, less than 60, less than 90, less than 120, less than 240, or less than 480 minutes. As used herein, a short half-life cytokine includes cytokines which have not been modified in their sequence to achieve a longer than usual half-life in the body of a subject and polypeptides that have altered amino acid sequences intended to extend the serum half-life yet retain receptor agonist activity. This latter case is not meant to include the addition of heterologous protein domains, such as a bona fide half-life extension element, such as serum albumin.

A "conservative" amino acid substitution, as used herein, generally refers to substitution of one amino acid residue with another amino acid residue from within a recognized group which can change the structure of the peptide but biological activity of the peptide is substantially retained. Conservative substitutions of amino acids are known to those skilled in the art. Conservative substitutions of amino acids can include, but not limited to, substitutions made amongst amino acids within the following groups: (a) M, I, L, V; (b) F, Y, W; (c) K, R, H; (d) A, G; (e) S, T; (f) Q, N; and (g) E, D. For instance, a person of ordinary skill in the art reasonably expect that an isolated replacement of a leucine with an isoleucine or valine, an aspartate with a glutamate, a threonine with a serine, or a similar replacement of an amino acid with a structurally related amino acid will not have a major effect on the biological activity of the resulting molecule.

"Sortases" are transpeptidases that modify proteins by recognizing and cleaving a carboxyl-terminal sorting signal embedded in or terminally attached to a target protein or peptide. Sortase A catalyzes the cleavage of the LPXTG motif (where X is any standard amino acid) (SEQ ID NO: 237) between the Thr and Gly residue on the target protein, with transient attachment of the Thr residue to the active site Cys residue on the enzyme, forming an enzyme-thioacyl intermediate. To complete transpeptidation and create the peptide-monomer conjugate, a biomolecule with an N-terminal nucleophilic group, typically an oligoglycine motif, attacks the intermediate, displacing Sortase A and joining the two molecules.

As used herein, the term "steric blocker" refers to a polypeptide or polypeptide moiety that can be covalently bonded to a cytokine polypeptide directly or indirectly through other moieties such as linkers, for example in the form of a chimeric polypeptide (fusion protein), but otherwise does not covalently bond to the cytokine polypeptide. A steric blocker can non-covalently bond to the cytokine polypeptide, for example though electrostatic, hydrophobic, ionic or hydrogen bonding. A steric blocker typically inhibits or blocks the activity of the cytokine moiety due to its proximity to the cytokine moiety and comparative size.

As used and described herein, a "half-life extension element" is a part of the chimeric polypeptide that increases the serum half-life and improve pK, for example, by altering its size (e.g., to be above the kidney filtration cutoff), shape, hydrodynamic radius, charge, or parameters of absorption, biodistribution, metabolism, and elimination.

The term "separation moiety" or "linker" as used herein refers to an amino acid sequence typically less than about 100 amino acids that connects or links a first amino acid sequence of interest (e.g., an amino acid sequence that folds to form a first protein domain) to a second amino acid sequence of interest (e.g., an amino acid sequence that folds to form a second protein domain) in a contiguous polypeptide chain. The separation moiety or linker typically include one or more protease cleavage sites and thus is protease cleavable. A "tandem linker" refers to a linker that comprises two or more protease cleavages sites which can be cleaved by the same or different proteases, and which can be arranged in any desired orientation, such as one cleavage site adjacent to another cleavage site, one cleavage site overlapping another cleavage site, one cleavage site following by another cleavage site with intervening amino acids between the two cleavage sites.

As used herein, the terms "activatable," "activate," "induce," and "inducible" refer to the ability of a protein, i.e. a cytokine, that is part of a conjugate, to bind its receptor and effectuate activity upon cleavage of additional elements from the conjugate.

As used herein, "plasmids" or "viral vectors" are agents that transport the disclosed nucleic acids into the cell without degradation and include a promoter yielding expression of the nucleic acid molecule and/or polypeptide in the cells into which it is delivered.

As used herein, the terms "peptide", "polypeptide", or "protein" are used broadly to mean two or more amino acids linked by a peptide bond. Protein, peptide, and polypeptide are also used herein interchangeably to refer to amino acid sequences. It should be recognized that the term polypeptide is not used herein to suggest a particular size or number of amino acids comprising the molecule and that a peptide of the invention can contain up to several amino acid residues or more.

As used throughout, "subject" can be a vertebrate, more specifically a mammal (e g a human, horse, cat, dog, cow, pig, sheep, goat, mouse, rabbit, rat, and guinea pig), birds, reptiles, amphibians, fish, and any other animal. The term does not denote a particular age or sex. Thus, adult and newborn subjects, whether male or female, are intended to be covered.

As used herein, "patient" or "subject" may be used interchangeably and can refer to a subject with a disease or disorder (e.g. cancer). The term patient or subject includes human and veterinary subjects.

As used herein the terms "treatment", "treat", "treating," or grammatically related terms refer to a method of reducing the effects of a disease or condition or symptom of the disease or condition. Thus, in the disclosed method, treatment can refer to at least about 10%, at least about 20%, at least about 30%, at least about 40%, at least about 50%, at least about 60%, at least about 70%, at least about 80%, at least about 90%, or substantially complete reduction in the severity of an established disease or condition or symptom of the disease or condition. For example, a method for treating a disease is considered to be a treatment if there is a 10% reduction in one or more symptoms of the disease in a subject as compared to a control. Thus, the reduction can be a 10%, 20%, 30%, 40%, 50%, 60%, 70%, 80%, 90%, 100%, or any percent reduction in between 10% and 100% as compared to native or control levels. It is well understood in the art that treatment does not necessarily refer to a cure or complete ablation of the disease, condition, or symptoms of the disease or condition. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis.

As used herein, the terms "prevent", "preventing", and "prevention" of a disease or disorder refers to an action, for example, administration of the chimeric polypeptide or nucleic acid sequence encoding the chimeric polypeptide, that occurs before or at about the same time a subject begins to show one or more symptoms of the disease or disorder, which inhibits or delays onset or exacerbation of one or more symptoms of the disease or disorder.

As used herein, references to "decreasing", "reducing", or "inhibiting" include a change of at least about 10%, of at least about 20%, of at least about 30%, of at least about 40%, of at least about 50%, of at least about 60%, of at least about 70%, of at least about 80%, of at least about 90% or greater as compared to a suitable control level. Such terms can include but do not necessarily include complete elimination of a function or property, such as agonist activity.

An "attenuated cytokine receptor agonist" is a cytokine receptor agonist that has decreased receptor agonist activity as compared to the cytokine receptor's naturally occurring agonist. An attenuated cytokine agonist may have at least about 10×, at least about 50×, at least about 100×, at least about 250×, at least about 500×, at least about 1000× or less agonist activity as compared to the receptor's naturally occurring agonist. When a fusion protein that contains a cytokine polypeptide as described herein is described as "attenuated" or having "attenuated activity", it is meant that the fusion protein is an attenuated cytokine receptor agonist.

An "intact fusion protein" is a fusion protein in which no domain has been removed from the fusion protein, for example by protease cleavage. A domain may be removable by protease cleavage or other enzymatic activity, but when the fusion protein is "intact", this has not occurred.

As used herein "moiety" refers to a portion of a molecule that has a distinct function within that molecule, and that function may be performed by that moiety in the context of another molecule. A moiety may be a chemical entity with a particular function, or a portion of a biological molecule with a particular function. For example, a "blocking moiety" within a fusion protein is a portion of the fusion protein which is capable of blocking the activity of some or all of the fusion polypeptide. This may be a protein domain, such as serum albumin.

A. Separation Moiety or Linker

The disclosure relates to novel protease cleavable separation moieties. As described herein, the protease cleavable separation moieties were designed so that the separation moieties are cleaved with high efficiency by proteases at a desired location (e.g., proteases that are selectively expressed or expressed at high levels in the tumor microenvironment) but are stable and not cleaved or cleaved with low efficiency in other locations (e.g., in the periphery, for example healthy tissue or serum).

The protease cleavable separation moieties were designed using a process that included prioritizing proteases that would be suitable for cleaving the separation moieties based on expression in target indications, such as, expression in particular types of tumors (e.g., colon, lung, breast, melanoma). Multiple data sources for increased expression or specific expression of proteases in the target indications were used, including mRNA, proteomics and tissue staining data. The proteases were also prioritized based on their specific activity as well as intrinsic specificity, with high specific activity and high intrinsic activity preferred. Stability in the serum is an important design consideration, and to avoid potential off-target cleavage of the separation moieties by serum proteases, proteases that are not dependent on arginine in their substrate were selected, since many off-target enzymes are active towards arginine residues.

Starting sequences for the design process were selected using a diverse peptide library as substrates for proteases with mass spectrometric detection of protease cleaved products to identify preferred sequence motifs for each candidate protease. For selected initial motifs, a new peptide library that was tailored to the preferred sequence motif for the candidate protease was designed, created and analyzed. The peptide motifs were also counter-screened for cleavage by the serum proteases thrombin and Factor Xa as well as the liver/kidney protease hepsin. This process yielded peptides containing sequence motifs that are cleaved by certain tumor-associated proteases (e.g., Matrix Metaloprotease 9 (MMP9), MMP14 and/or Cathepsin L) with high efficiency, but are stable (not cleaved or cleaved with low efficiency) in the serum or normal healthy tissue (e.g., by thrombin, Factor Xa, hepsin and the like). The separation moieties disclosed herein are efficient cleavage by human tumors and minimal cleavage by normal tissues or serum.

This disclosure relates to separation moieties or linkers that connect a first amino acid sequence of interest (e.g. a first domain of interest) to a second amino acid sequence of interest (e.g. a second domain of interest). Typically, the first amino acid sequence of interest and the second amino acid sequence of interest are not found together in a naturally occurring protein. For example, the separation moiety can connect or link a first domain of interest to a second domain of interest in a fusion protein. The separation moiety is an amino acid sequence that can be of any suitable length, and preferably can be cleaved by a protease.

The separation moieties disclosed herein can confer functionality, including flexibility as well as the ability to be cleaved. Flexible linkers are usually applied when joined domains requires a certain degree of movement or interaction. Cleavable linkers are introduced to release free and functional domains in vivo at a target site. The separation moieties disclosed herein serve to connect at least two domains of interest. The separation moieties can maintain cooperative inter-domain interactions or preserving biological activity. The separation moieties can join functional domains (e.g., a payload and half-life extension element) that are released from the separation moiety at a target site (e.g. a tumor microenvironment).

In a preferred embodiment, the separation moiety is cleavable by a cleaving agent, e.g., an enzyme. Preferably, the separation moiety comprises a protease cleavage site. In some cases, the separation moiety comprises one or more cleavage sites. The separation moiety can comprise a single protease cleavage site. The separation moiety can also comprise 2 or more protease cleavage sites. For example, 2 cleavage sites, 3 cleavage sites, 4, cleavage sites, 5 cleavage sites, or more. In cases the separation moiety comprises 2 or more protease cleavage sites, the cleavage sites can be cleaved by the same protease or different proteases. A separation moiety comprising two or more cleavage sites is referred to as a "tandem linker." The two or more cleavage sites can be arranged in any desired orientation, including, but not limited tom one cleavage site adjacent to another cleavage site, one cleavage site overlapping another cleavage site, or one cleavage site following by another cleavage site with intervening amino acids between the two cleavage sites.

Of particular interest in the present invention are disease specific protease-cleavable linkers. Also preferred are protease-cleavable linkers that are preferentially cleaved at a desired location in the body, such as the tumor microenvironment, relative to the peripheral circulation. For example, the rate at which the protease-cleavable linker is cleaved in the tumor microenvironment can be at least about 10 times, at least about 100 times, at least about 1000 times or at least about 10,000 times faster in the desired location in the body, e.g., the tumor microenvironment, in comparison to in the peripheral circulation (e.g., in plasma).

Proteases known to be associated with diseased cells or tissues include but are not limited to serine proteases, cysteine proteases, aspartate proteases, threonine proteases, glutamic acid proteases, metalloproteases, asparagine peptide lyases, serum proteases, cathepsins, Cathepsin B, Cathepsin C, Cathepsin D, Cathepsin E, Cathepsin G, Cathepsin K, Cathepsin L, kallikreins, hK1, hK10, hK15, plasmin, collagenase, Type IV collagenase, stromelysin, Factor Xa, chymotrypsin-like protease, trypsin-like protease, elastase-like protease, subtilisin-like protease, actinidain, bromelain, calpain, caspases, caspase-3, Mirl-CP, papain, HIV-1 protease, HSV protease, CMV protease, chymosin, renin, pepsin, matriptase, legumain, plasmepsin, nepenthesin, metalloexopeptidases, metalloendopeptidases, matrix metalloproteases (MMP), MMP1, MMP2, MMP3, MMP8, MMP9, MMP13, MMP11, MMP14, urokinase plasminogen activator (uPA), enterokinase, prostate-specific antigen (PSA, hK3), interleukin-1β converting enzyme, thrombin, FAP (FAPα), dipeptidyl peptidase, meprins, granzymes and dipeptidyl peptidase IV (DPPIV/CD26). Proteases capable of cleaving linker amino acid sequences (which can be encoded by the chimeric nucleic acid sequences provided herein) can, for example, be selected from the group consisting of a prostate specific antigen (PSA), a matrix metalloproteinase (MMP), an A Disintigrin and a Metalloproteinase (ADAM), a plasminogen activator, a cathepsin, a caspase, a tumor cell surface protease, and an elastase. The MMP can, for example, be matrix metalloproteinase 2 (MMP2), matrix metalloproteinase 9 (MMP9), matrix metalloproteinase 14 (MMP14). In addition, or alternatively, the linker can be cleaved by a cathepsin, such as, Cathepsin B, Cathepsin C, Cathepsin D, Cathepsin E, Cathepsin G, Cathepsin K and/or Cathepsin L. Preferably, the linker can be cleaved by MMP14 or Cathepsin L.

Proteases useful for cleavage of linkers and for use in the methods disclosed herein are presented in Table 1, and exemplary proteases and their cleavage site are presented in Table 1a:

TABLE 1

| Protease | Specificity | Other aspects |
|---|---|---|
| Proteases relevant to inflammation and cancer | | |
| Secreted by killer T cells: | | |
| Granzyme B (grB) | Cleaves after Asp residues (asp-ase) | Type of serine protease; strongly implicated in inducing perforin-dependent target cell apoptosis |
| Granzyme A (grA) | trypsin-like, cleaves after basic residues | Type of serine protease; |

TABLE 1-continued

Proteases relevant to inflammation and cancer

| Protease | Specificity | Other aspects |
|---|---|---|
| Granzyme H (grH) | Unknown substrate specificity | Type of serine protease; Other granzymes are also secreted by killer T cells, but not all are present in humans |
| Caspase-8 | Cleaves after Asp residues | Type of cysteine protease; plays essential role in TCR-induced cellular expansion-exact molecular role unclear |
| Mucosa-associated lymphoid tissue (MALT1) | Cleaves after arginine residues | Type of cysteine protease; likely acts both as a scaffold and proteolytically active enzyme in the CBM-dependent signaling pathway |
| Tryptase | Targets: angiotensin I, fibrinogen, prourokinase, TGFβ; preferentially cleaves proteins after lysine or arginine residues | Type of mast cell-specific serine protease; trypsin-like; resistant to inhibition by macromolecular protease inhibitors expressed in mammals due to their tetrameric structure, with all sites facing narrow central pore; also associated with inflammation |

Associated with inflammation:

| Protease | Specificity | Other aspects |
|---|---|---|
| Thrombin | Targets: FGF-2, HB-EGF, Osteo-pontin, PDGF, VEGF | Type of serine protease; modulates activity of vascular growth factors, chemokines and extracellular proteins; strengthens VEGF-induced proliferation; induces cell migration; angiogenic factor; regulates hemostasis |
| Chymase | Exhibit chymotrypsin-like specificity, cleaving proteins after aromatic amino acid residues | Type of mast cell-specific serine protease |
| Carboxypeptidase A (MC-CPA) | Cleaves amino acid residues from C-terminal end of peptides and proteins | Type of zinc-dependent metalloproteinase |
| Kallikreins | Targets: high molecular weight kininogen, pro-urokinase | Type of serine protease; modulate relaxation response; contribute to inflammatory response; fibrin degradation |
| Elastase | Targets: E-cadherin, GM-CSF, IL-1, IL-2, IL-6, IL8, p38$^{MARK}$, TNFα, VE-cadherin | Type of neutrophil serine protease; degrades ECM components; regulates inflammatory response; activates pro-apoptotic signaling |
| Cathepsin G | Targets: EGF, ENA-78, IL-8, MCP-1, MMP-2, MT1-MMP, PAI-1, RANTES, TGFβ, TNFα | Type of serine protease; degrades ECM components; chemo-attractant of leukocytes; regulates inflammatory response; promotes apoptosis |
| PR-3 | Targets: ENA-78, IL-8, IL-18, JNK, p38$^{MARK}$, TNFα | Type of serine protease; promotes inflammatory response; activates pro-apoptotic signaling |
| Granzyme M (grM) | Cleaves after Met and other long, unbranched hydrophobic residues | Type of serine protease; only expressed in NK cells |
| Calpains | Cleave between Arg and Gly | Family of cysteine proteases; calcium-dependent; activation is involved in the process of numerous inflammation-associated diseases |

TABLE 1a

Exemplary Proteases and Protease Recognition Sequences

| Protease | Cleavage Domain Sequence | SEQ ID NO: |
|---|---|---|
| MMP7 | KRALGLPG | 3 |
| MMP7 | (DE)$_8$RPLALWRS(DR)$_8$ | 4 |

TABLE 1a-continued

Exemplary Proteases and Protease Recognition Sequences

| Protease | Cleavage Domain Sequence | SEQ ID NO: |
|---|---|---|
| MMP9 | PR(S/T)(L/I)(S/T) | 5 |
| MMP9 | LEATA | 6 |
| MMP11 | GGAANLVRGG | 7 |
| MMP14 | SGRIGFLRTA | 8 |
| MMP | PLGLAG | 9 |
| MMP | PLGLAX | 10 |
| MMP | PLGC(me)AG | 11 |
| MMP | ESPAYYTA | 12 |
| MMP | RLQLKL | 13 |
| MMP | RLQLKAC | 14 |
| MMP2, MMP9, MMP14 | EP(Cit)G(Hof)YL | 15 |
| Urokinase plasminogen activator (uPA) | SGRSA | 16 |
| Urokinase plasminogen activator (uPA) | DAFK | 17 |
| Urokinase plasminogen activator (uPA) | GGGRR | 18 |
| Lysosomal Enzyme | GFLG | 19 |
| Lysosomal Enzyme | ALAL | 20 |
| Lysosomal Enzyme | FK | 21 |
| Cathepsin B | NLL | 22 |
| Cathepsin D | PIC(Et)FF | 23 |
| Cathepsin K | GGPRGLPG | 24 |
| Prostate Specific Antigen | HSSKLQ | 25 |
| Prostate Specific Antigen | HSSKLQL | 26 |
| Prostate Specific Antigen | HSSKLQEDA | 27 |
| Herpes Simplex Virus Protease | LVLASSSFGY | 28 |
| HIV Protease | GVSQNYPIVG | 29 |
| CMV Protease | GVVQASCRLA | 30 |
| Thrombin | F(Pip)RS | 31 |
| Thrombin | DPRSFL | 32 |
| Thrombin | PPRSFL | 33 |
| Caspase-3 | DEVD | 34 |
| Caspase-3 | DEVDP | 35 |
| Caspase-3 | KGSGDVEG | 36 |
| Interleukin 1β converting enzyme | GWEHDG | 37 |
| Enterokinase | EDDDDKA | 38 |
| FAP | KQEQNPGST | 39 |
| Kallikrein 2 | GKAFRR | 40 |
| Plasmin | DAFK | 41 |
| Plasmin | DVLK | 42 |

TABLE 1a-continued

Exemplary Proteases and Protease Recognition Sequences

| Protease | Cleavage Domain Sequence | SEQ ID NO: |
|---|---|---|
| Plasmin | DAFK | 43 |
| TOP | ALLLALL | 44 |
| | GPLGVRG | 221 |
| | IPVSLRSG | 222 |
| | VPLSLYSG | 223 |
| | SGESPAYYTA | 224 |

Exemplary protease linkers include, but are not limited to kallikrein cleavable linkers, thrombin cleavable linkers, chymase cleavable linkers, carboxypeptidase A cleavable linkers, cathepsin cleavable linkers, elastase cleavable linkers, FAP cleavable linkers, ADAM cleavable linkers, PR-3 cleavable linkers, granzyme M cleavable linkers, a calpain cleavable linkers, a matrix metalloproteinase (MMP) cleavable linkers, a plasminogen activator cleavable linkers, a caspase cleavable linkers, a tryptase cleavable linkers, or a tumor cell surface protease. Specifically, MMP9 cleavable linkers, ADAM cleavable linkers, CTSL1 cleavable linkers, FAPa cleavable linkers, and cathepsin cleavable linkers. Some preferred protease-cleavable linkers are cleaved by a MMP and/or a cathepsin.

The separation moieties disclosed herein are typically less than 100 amino acids. Such separation moieties can be of different lengths, such as from 1 amino acid (e.g., Gly) to 30 amino acids, from 1 amino acid to 40 amino acids, from 1 amino acid to 50 amino acids, from 1 amino acid to 60 amino acids, from 1 to 70 amino acids, from 1 to 80 amino acids, from 1 to 90 amino acids, and from 1 to 100 amino acids. In some embodiments, the linker is at least about 1, about 2, about 3, about 4, about 5, about 10, about 15, about 20, about 25, about 30, about 35, about 40, about 45, about 50, about 55, about 60, about 65, about 70, about 75, about 80, about 85, about 90, about 95, or about 100 amino acids in length. Preferred linkers are typically from about 5 amino acids to about 30 amino acids.

Preferably the lengths of linkers vary from 2 to 30 amino acids, optimized for each condition so that the linker does not impose any constraints on the conformation or interactions of the linked domains.

```
In some embodiments, the separation moiety
comprises the sequence
                              (SEQ ID NO: 195)
GPAGLYAQ;

(SEQ ID NO: 196)
GPAGMKGL;

(SEQ ID NO: 197)
PGGPAGIG;

(SEQ ID NO: 198)
ALFKSSFP;

(SEQ ID NO: 199)
ALFFSSPP;
```

```
                              (SEQ ID NO: 200)
LAQRLRSS;

(SEQ ID NO: 201)
LAQKLKSS;

(SEQ ID NO: 202)
GALFKSSFPSGGGPAGLYAQGGSGKGGSGK;

(SEQ ID NO: 203)
RGSGGGPAGLYAQGSGGGPAGLYAQGGSGK;

(SEQ ID NO: 204)
KGGGPAGLYAQGPAGLYAQGPAGLYAQGSR;

(SEQ ID NO: 205)
RGGPAGLYAQGGPAGLYAQGGGPAGLYAQK;

(SEQ ID NO: 206)
KGGALFKSSFPGGPAGIGPLAQKLKSSGGS;

(SEQ ID NO: 207)
SGGPGGPAGIGALFKSSFPLAQKLKSSGGG;

(SEQ ID NO: 208)
RGPLAQKLKSSALFKSSFPGGPAGIGGGGK;

(SEQ ID NO: 209)
GGGALFKSSFPLAQKLKSSPGGPAGIGGGR;

(SEQ ID NO: 210)
RGPGGPAGIGPLAQKLKSSALFKSSFPGGG;

(SEQ ID NO: 211)
RGGPLAQKLKSSPGGPAGIGALFKSSFPGK;

(SEQ ID NO: 212)
RSGGPAGLYAQALFKSSFPLAQKLKSSGGG;

(SEQ ID NO: 213)
GGPLAQKLKSSALFKSSFPGPAGLYAQGGR;

(SEQ ID NO: 214)
GGALFKSSFPGPAGLYAQPLAQKLKSSGGK;

(SEQ ID NO: 215)
RGGALFKSSFPLAQKLKSSGPAGLYAQGGK;

(SEQ ID NO: 216)
RGGGPAGLYAQPLAQKLKSSALFKSSFPGG;

(SEQ ID NO: 217)
SGPLAQKLKSSGPAGLYAQALFKSSFPGSK;

(SEQ ID NO: 218)
KGGPGGPAGIGPLAQRLRSSALFKSSFPGR;
```

KSGPGGPAGIGALFFSSPPLAQKLKSSGGR; (SEQ ID NO: 219)

or

SGGFPRSGGSFNPRTFGSKRKRRGSRGGGG (SEQ ID NO: 220)

Certain preferred separation moieties comprises the sequence GPAGLYAQ (SEQ ID NO: 195) or ALFKSSFP (SEQ ID NO: 198). The separation moieties disclosed herein can comprise one or more cleavage motif or functional variants that are the same or different. The separation moieties can comprise 1, 2, 3, 4, 5, or more cleavage motifs or functional variants. Separation moieties comprising 30 amino acids can contain 2 cleavage motifs or functional variants, 3 cleavage motifs or functional variants or more. A "functional variant" of a separation moiety retains the ability to be cleaved with high efficiency at a target site (e.g., a tumor microenvironment that expresses high levels of the protease) and are not cleaved or cleaved with low efficiency in the periphery (e.g., serum). For example, the functional variants retain at least about 50%, about 55%, about 60%, about 70%, about 80%, about 85%, about 95% or more of the cleavage efficiency of a separation moiety comprising any one of SEQ ID NOs. 195-220.

The separation moieties comprising more than one cleavage motif can be selected from SEQ ID NOs: 195-201 and combinations thereof. Preferred separation moieties comprising more than one cleavage motif comprise the amino acids selected from SEQ ID NO: 202-220.

The separation moiety can comprise both ALFKSSFP (SEQ ID NO: 198) and GPAGLYAQ (SEQ ID NO: 195). The separation moiety can comprise two cleavage motifs that each have the sequence GPAGLYAQ (SEQ ID NO: 195). Alternatively or additionally, the separation moiety can comprise two cleavage motifs that each have the sequence ALFKSSFP (SEQ ID NO: 198). The separation moiety can comprise a third cleavage motif that is the same or different.

In some embodiments, the separation moiety comprises an amino acid sequence that is at least about 90%, at least about 95%, at least about 96%, at least about 97%, at least about 98%, or at least 99% identical to SEQ ID NOs: 195 to SEQ ID NO: 220 over the full length of SEQ ID NO: 195-220.

The disclosure also relates to functional variants of separation moieties comprising SEQ ID NOs. 195-220. The functional variants of separation moieties comprising SEQ ID NOs: 195-220 generally differ from SEQ ID NOs. 195-220 by one or a few amino acids (including substitutions, deletions, insertions, or any combination thereof), and substantially retain their ability to be cleaved by a protease.

The functional variants can contain at least one or more amino acid substitutions, deletions, or insertions relative to the separation moieties comprising SEQ ID NOs. 195-220. The functional variant can comprise 1, 2, 3, 4, 5, 6, 7, 8, 9, or 10 amino acid alterations computed to the separation moieties comprising SEQ ID NOs. 195-220. In some preferred embodiments, the functional variant differs from the separation moiety comprising SEQ ID NOs. 195-220 by less than 10, less, than 8, less than 5, less than 4, less than 3, less than 2, or one amino acid alterations, e.g., amino acid substitutions or deletions. In other embodiments, the functional variant may comprise 1, 2, 3, 4, 5, 6, 7, 8, 9, or 10 amino acid substitutions compared to SEQ ID NOs. 195-220. The amino acid substitution can be a conservative substitution or a non-conservative substitution, but preferably is a conservative substitution.

In other embodiments, the functional variants of the separation moieties may comprise 1, 2, 3, 4, or 5 or more non-conservative amino acid substitutions compared the separation moieties comprising SEQ ID NOs: 195-220. Non-conservative amino acid substitutions could be recognized by one of skill in the art. The functional variant of the separation moiety preferably contains no more than 1, 2, 3, 4, or 5 amino acid deletions.

The amino acid sequences disclosed in the separation moieties can be described by the relative linear position in the separation moiety with respect to the sissile bond. As will be well-understood by persons skilled in the art, separation moieties comprising 8 amino acid protease substrates (e.g., SEQ ID Nos: 195-201) contain amino acid at positions P4, P3, P2, P1, P1', P2', P3', P4', wherein the sissile bond is between P1 and P1'. For example, amino acid positions for the separation moiety comprising the sequence GPAGLYAQ (SEQ ID NO: 195) can be described as follows:

| G | P | A | G | L | Y | A | Q |
|---|---|---|---|---|---|---|---|
| P4 | P3 | P2 | P1 | P1' | P2' | P3' | P4' |

Amino acids positions for the separation moiety comprising the sequence ALFKSSFP (SEQ ID NO: 198) can be described as follows:

| A | L | F | K | S | S | F | P |
|---|---|---|---|---|---|---|---|
| P4 | P3 | P2 | P1 | P1' | P2' | P3' | P4' |

Preferably, the amino acids surrounding the cleavage site (e.g., positions P1 and P1' for SEQ ID NOs: 195-201) are not substituted.

In embodiments, the separation moiety comprises the sequence GPAGLYAQ (SEQ ID NO: 195) or ALFKSSFP (SEQ ID NO: 198) or a functional variant of SEQ ID NO: 195 or a function variant of SEQ ID NO: 198. As described herein, a functional variant of PAGLYAQ (SEQ ID NO: 195) or ALFKSSFP (SEQ ID NO: 198) can comprise one or more amino acid substitutions, and substantially retain their ability to be cleaved by a protease. Specifically, the functional variants of GPAGLYAQ (SEQ ID NO: 195) is cleaved by MMP14, and the functional variant of ALFKSSFP (SEQ ID NO: 198) is cleaved by Capthepsin L (CTSL1). The functional variants also retain their ability to be cleaved with high efficiency at a target site (e.g., a tumor microenvironment that expresses high levels of the protease). For example, the functional variants of GPAGLYAQ (SEQ ID NO: 195) or ALFKSSFP (SEQ ID NO: 198) retain at least about 50%, about 55%, about 60%, about 70%, about 80%, about 85%, about 95% or more of the cleavage efficiency of a separation moiety comprising amino acid sequence GPAGLYAQ (SEQ ID NO: 195) or ALFKSSFP (SEQ ID NO: 198), respectively.

Preferably, the functional variant of GPAGLYAQ (SEQ ID NO: 195) or ALFKSSFP (SEQ ID NO: 198) comprise no more than 1, 2, 3, 4, or 5 conservative amino acid substitutions compared to GPAGLYAQ (SEQ ID NO: 195) or ALFKSSFP (SEQ ID NO: 198). Preferably, the amino acids at position P1 and P1' are not substituted. The amino acids at positions P1 and P1' in SEQ ID NO: 195 are G and L, and the amino acids at positions P1 and P1' in SEQ ID NO: 198 are K and S.

The functional variant of GPAGLYAQ (SEQ ID NO: 195) can preferably comprise one or more of the following: a) an arginine amino acid substitution at position P4, b) a leucine, valine, asparagine, or proline amino acid substitution at position P3, c) a asparagine amino acid substitution at position P2, d) a histidine, asparagine, or glycine amino acid substitution at position P1, e) a asparagine, isoleucine, or leucine amino acid substitution at position P1', f) a tyrosine or arginine amino acid substitution at position P2', g) a glycine, arginine, or alanine amino acid substitution at position P3', h) or a serine, glutamine, or lysine amino acid substitution at position P4'. The following amino acid substitutions are disfavored in functional variants of GPAGLYAQ (SEQ ID NO: 195): a) arginine or isoleucine at position P3, b) alanine at position P2, c) valine at position P1, d) arginine, glycine, asparagine, or threonine at position P1', e) aspartic acid or glutamic acid at position P2', f) isoleucine at position P3', g) valine at position P4'. In some embodiments, the functional variant of GPAGLYAQ (SEQ ID NO: 195) does not comprise an amino acid substitution at position P1 and/or P1'.

The amino acid substitution of the functional variant of GPAGLYAQ (SEQ ID NO: 195) preferably comprises an amino acid substitution at position P4 and/or P4'. For example, the functional variant of GPAGLYAQ (SEQ ID NO: 195) can comprises a leucine at position P4, or serine, glutamine, lysine, or phenylalanine at position P4. Alternatively or additionally, the functional variant of GPAGLYAQ (SEQ ID NO: 195) can comprises a glycine, phenylalanine, or a proline at position P4'.

In some embodiments, the amino acid substitutions at position P2 or P2' of GPAGLYAQ (SEQ ID NO: 195) are not preferred.

In some embodiments, the functional variant of GPAGLYAQ (SEQ ID NO: 195) comprises the amino acid sequence selected from SEQ ID NOs: 258-331. Specific functional variants of GPAGLYAQ (SEQ ID NO: 195) include GPLGLYAQ (SEQ ID NO: 295), and GPAGLKGA (SEQ ID NO: 285).

The functional variants of LFKSSFP (SEQ ID NO: 198) preferably comprises hydrophobic amino acid substitutions. The functional variant of LFKSSFP (SEQ ID NO: 198) can preferably comprise one or more of the following: (a) lysine, histidine, serine, glutamine, leucine, proline, or phenylalanine at position P4; (b) lysine, histidine, glycine, proline, asparagine, phenylalanine at position P3; (c) arginine, leucine, alanine, glutamine, or histatine at position P2; (d) phenylalanine, histidine, threonine, alanine, or glutamine at position P1; (e) histidine, leucine, lysine, alanine, isoleucine, arginine, phenylalanine, asparagine, glutamic acid, or glycine at position P1', (f) phenylalanine, leucine, isoleucine, lysine, alanine, glutamine, or proline at position P2'; (g) phenylalanine, leucine, glycine, serine, valine, histidine, alanine, or asparagine at position P3'; and phenylalanine, histidine, glycine, alanine, serine, valine, glutamine, lysine, or leucine.

The inclusion of aspartic acid and/or glutamic acid in functional variants of SEQ ID NO:198 are generally disfavored and avoided. The following amino acid substitutions are also disfavored in functional variants of LFKSSFP (SEQ ID NO: 198): (a) alanine, serine, or glutamic acid at position P3; (b) proline, threonine, glycine, or aspartic acid at position P2; (c) proline at position P1; (d) proline at position P1'; (e) glycine at position P2'; (f) lysine or glutamic acid at position P3'; (g) aspartic acid at position P4'.

The amino acid substitution of the functional variant of LFKSSFP (SEQ ID NO: 198) preferably comprises an amino acid substitution at position P4 and/or P1. In some embodiments, an amino acid substitution of the functional variant of LFKSSFP (SEQ ID NO: 198) at position P4' is not preferred.

In some embodiments, the functional variant of LFKSSFP (SEQ ID NO: 198) comprises the amino acid sequence selected from SEQ ID NOs: 332-408. Specific functional variants of LFKSSFP (SEQ ID NO: 198) include ALFFSSPP (SEQ ID NO: 199), ALFKSFPP (SEQ ID NO: 381), ALFKSLPP (SEQ ID NO: 382); ALFKHSPP (SEQ ID NO: 370); ALFKSIPP (SEQ ID NO: 383); ALFKSSLP (SEQ ID NO: 390); or SPFRSSRQ (SEQ ID NO: 333).

The separation moieties disclosed herein can form a stable complex under physiological conditions with the amino acid sequences (e.g. domains) that they link, while being capable of being cleaved by a protease. For example, the separation moiety is stable (e.g., not cleaved or cleaved with low efficiency) in the circulation and cleaved with higher efficiency at a target site (i.e. a tumor microenvironment). Accordingly, fusion polypeptides that include the linkers disclosed herein can, if desired, have a prolonged circulation half-life and/or lower biological activity in the circulation in comparison to the components of the fusion polypeptide as separate molecular entities. Yet, when in the desired location (e.g., tumor microenvironment) the linkers can be efficiently cleaved to release the components that are joined together by the linker and restoring or nearly restoring the half-life and biological activity of the components as separate molecular entities.

The separation moiety desirably remains stable in the circulation for at least 2 hours, at least 5, hours, at least 10 hours, at least 15 hours, at least 20 hours, at least 24 hours, at least 30 hours, at least 35 hours, at least 40 hours, at least 45 hours, at least 50 hours, at least 60 hours, at least 65 hours, at least 70 hours, at least 80 hours, at least 90 hours, or longer.

In some embodiments, the separation moiety is cleaved by less than 90%, 80%, 70%, 60%, 50%, 40%, 30%, 20%, 20%, 5%, or 1% in the circulation as compared to the target location. The separation moiety is also stable in the absence of an enzyme capable of cleaving the linker. However, upon expose to a suitable enzyme (i.e., a protease), the separation moiety is cleaved resulting in separation of the linked domain.

B. Polypeptides and Compositions Comprising a Separation Moiety

The separation moieties disclosed herein can be used in a wide range of applications. Without limitation, they are suitable for us in fusion proteins. As further described herein, the separation moieties are particularly useful for preparing therapeutic fusion proteins in which the therapeutic of biological activity of the fusion protein is attenuated and the attenuation is removed upon cleavage of the separation moiety. The separation moieties can also be used to conjugate a variety of payloads such as therapeutic and/or diagnostic agents to carriers or targeting agents (e.g., antibodies and fragments of antibodies, nanoparticles). Suitable methods for prepare such conjugates are well-known in the art, see for example, Bioconjugate Techniques, Third Ed., G. T. Hermanson (Ed.) Academic Press 2013. Exemplary payloads include, but are not limited to cytokines, antibodies, cell based-therapies, antibiotics, cytotoxic drugs, or other recombinant polypeptide complexes. Of specific interest are separation moieties that are suitable for use in conjugation with payloads that target or are targeted to tumor microenvironments.

This disclosure relates recombinant polypeptides in which a separation moiety as disclosed herein links a first amino acid sequence of interest (e.g. a first domain of interest) to a second amino acid sequence of interest (e.g. a second domain of interest). Typically, the first amino acid sequence of interest and the second amino acid sequence of interest are not found together in a naturally occurring protein. Preferred linkers are SEQ ID NOS:195-220. In embodiments, at least one of the first amino acid sequence of interest and the second amino acid sequence of interest is the amino acid sequence of a therapeutic polypeptide. In some embodiments in which at least one of the first amino acid sequence of interest and the second amino acid sequence of interest is the amino acid sequence of a therapeutic polypeptide, the other amino acid sequence of interest can be the amino acid sequence of a targeting polypeptide, a half-life extending polypeptide and/or a blocking polypeptide.

The polypeptides that contain a separation moiety can be represented by Formula I: [DI]-[L1]-[D2], wherein D1 is a first amino acid sequence of interest (e.g., a domain of interest), L1 is a separation moiety that connects or links D1 to D2; and D2 is a second amino acid sequence of interest (e.g., a second domain of interest). Preferably, L1 is a protease-cleavable separation moiety, and more preferably L1 comprises or consists of any of SEQ ID NOS: 195-220.

The polypeptides can also be represented by Formula II: [D1]-[L1]-[D2]-[L2]-[D3], wherein D1 is a first amino acid of interest (e.g., a domain of interest), L1 and L2 are each, independently, a linker; D2 is a second amino acid sequence of interest (e.g., a domain of interest), and D3 is a third amino acid of interest (e.g., a domain of interest), wherein at least one of L1 and L2 is a protease-cleavable separation moiety, and preferably at least one of L1 and L2 comprises or consists of any of SEQ ID NOS: 195-220.

The polypeptide can also be represented by Formula III: [D1]-[L1]-[D2]-[L2]-[D3]-[L3]-[D4], wherein D1 is a first amino acid of interest (e.g., a domain of interest), L1, L2 and L3 are each, independently, a linker; D2 is a second amino acid sequence of interest (e.g., a domain of interest), D3 is a third amino acid of interest (e.g., a domain of interest); and wherein D4 is a fourth amino acid of interest (e.g., a domain of interest), wherein at least one of L1, L2 and L3 is a protease-cleavable separation moiety, and preferably at least one of L1, L2 and L3 comprises or consists of any of SEQ ID NOS: 195-220.

Additional specific applications of the separation moieties are described in more detail herein.

i. Delivery of Payloads

The separation moieties as described herein can be used to attach a therapeutic drug-moiety. In this approach, a therapeutic drug moiety is attached to the separation moiety to make a therapeutic drug moiety complex. The separate drug moiety complex can be a prodrug that is inactive until the target protease cleaves the prodrug, releasing the free drug.

ii. Antibody-Drug Conjugates

Another example of use of the separation moiety is in the field of antibody-drug conjugates (ADCs) that are mainly directed toward the treatment of cancer. ADCs typically are an antibody that is linked to a cytotoxic moiety, such as a cytotoxic drug. The ADCs discriminate between the healthy and diseased cells and provide targeted delivery of drug (e.g. cytotoxic drug) to diseased cells. ADCs typically comprise an antibody that targets a tumor marker that is specific to tumor cells, whereupon the antibody attaches itself to the tumor cell, causing the ADC to be absorbed into the cell, which enables the cytotoxic component to be released to kill the tumor cell. A key aspect of ADCs is the provision of a stable linker between the antibody component and the cytotoxic agent. In such applications, linkers may be cleavable or non-cleavable. For non-cleavable linkers, the antibody, linker and cytotoxic unit is incorporated into the tumor cell. The nature of the linker typically determines the release profile of the cytotoxic agent. For example, cleavable linkers between the antibody and the cytotoxic agent are typically catalyzed by enzymes in the tumor cell or in the tumor microenvironment, wherein the antibody and the cytotoxic agents are cleaved to release the cytotoxic agent.

In certain embodiments, the separation moiety disclosed herein links or connects a drug moiety to an antibody moiety.

iii. Peptide-Drug Conjugates

The separation moieties disclosed herein are suitable for use in peptide-drug conjugates. These compounds typically comprise a cytotoxic payload and linker; however, instead of antibodies, peptide-drug conjugates are equipped with peptides that have the ability to penetrate tumors, thus allowing the cargo to be delivered inside the tumor. In some embodiments, the separation moiety links or connects a cytotoxic payload with a peptide. The peptide-drug conjugate remains stable and has no biological activity until the target protease cleaves the separation moiety.

iv. Inducible Adoptive Cell Therapy

The separation moieties disclosed herein are suitable for use in constructs engineered for use in adoptive cell transfer (ACT) therapies. The field of adoptive cell transfer (ACT) is currently comprised of chimeric antigen receptor (CAR) engineered T cells (and next generation therapies) that target T cells to cell surface expressed targets (e.g., tumor cells expressing surface targets), and T cell receptor (TCR) engineered T cells that can target intracellular antigens.

In one embodiment, the separation moiety is used to tether a targeting moiety to a CAR construct. A CAR replaces the endogenous TCR complex with a new receptor that uses a fragment of a human or mouse antibody to bind to targets outside of a cancer cell. The antibody fragment is linked to various signaling proteins inside T-cell which mediate receptor activation when the CAR binds to its target. Porter et al., (2011) NEJM, 365:725-733; Grupp et al., (2013) NEJM, 368:1509-1518; U.S. Ser. No. 10/221,245/WO/2014/153270, Treatment of cancer using humanized anti-CD19 chimeric antigen receptor.

In another embodiment, the separation moiety is used to tether a targeting moiety to a TCR construct. A TCR is based on the gene for the protein receptor that is already naturally present in T-cells. The gene for a desired TCR can be discovered in a single patient, e.g., a patient that is able to mount an effective immune response against a type of cancer. This gene can then be introduced into other patients by incorporating it into TCR T cell constructs or reengineered to improve the binding interaction with its MHC target. Guy et al., (2013) Nat Immunol., 14(3):262-70; Kuhns et al., (2012) Front Immunol., 25; 3:159; Fesnak et al., (2016) Nat Rev Cancer, 16(9): 566-581.

These types of engineered T cells, whether autologous or allogenic, comprise engineered T cell receptor components that comprise a targeting agent such as an isolated human or humanized antibody. In CAR-T and TCR-T cells, the binding affinity of the targeting moiety may be affected by the steric, chemical, or flexibility properties of the separation moiety tethering the targeting moiety to the rest of the v. Antigen-binding Proteins The separation moieties disclosed herein are suitable for use in antigen-binding proteins. An "antigen-binding protein" (ABP) is a protein comprising one or more antigen-binding domains that specifically bind to an antigen or epitope. In some embodiments, the antigen-binding domain binds the antigen or epitope with specificity and affinity similar to that of naturally occurring antibodies. Typically, the separation moieties link a polypeptide that blocks the antigen-binding site of the ABP from binding to its cognate antigen. But when the separation moiety is cleaved the blocking polypeptide can diffuse away from the ABP antigen binding site and the ABP can bind to its cognate antigen. Exemplary binding polypeptides that can block the antigen binding site of an ABP include steric blocker such as human serum albumin, and peptides that interact with one or more of the complementarity determining regions (CDRs) in the antigen binding site of the ABP. Such blocking peptides can be obtained by screening libraries or by screening peptide fragments of the cognate antigen of an ABP of interest. Typically, when the ABP contains and an antigen binding site of an antibody, the separation moiety and blocker will be bonded to the amino terminus of the antibody light chain, or the amino terminus of the antibody heavy chain, so that the blocker is tethered close to and will readily block the antigen binding site. Suitable variations of this approach are used when the ABP contains an alternative scaffold for the binding site. Similarly, when single chain antibody binding sites are use, such as scFV of dAb, the blocker-separation moiety is typically bonded to the amino terminus near the antigen binding site. In certain embodiments, the ABP comprises an antibody binding site that comprises a VH and a VL, and the blocker-separation moiety is bonded to the amino terminus of the VL.

The ABP can be an antibody (e.g., the first and second antigen binding domains are in the form of an antibody). Preferably, at least one antigen binding domain of the ABP is in the form of an antibody. In another preferred embodiment, a first or second antigen binding domain is in the form of an antibody, and a first or second antigen binding domain is in the form of an antigen-binding fragment (e.g., the first antigen binding domain is an antibody and the second antigen binding domain is an antigen-binding fragment. Alternatively, the first antigen binding domain is an antigen binding fragment and the second antigen binding domain is an antibody).

In some embodiments, the ABP consists of an antibody. In some embodiments, the ABP consists essentially of an antibody. In some embodiments, the ABP comprises an alternative scaffold. In some embodiments, the ABP consists of an alternative scaffold. In some embodiments, the ABP consists essentially of an alternative scaffold. In some embodiments, the ABP comprises an antibody fragment. In some embodiments, the ABP consists of an antibody fragment. In some embodiments, the ABP consists essentially of an antibody fragment.

In some embodiments, the separation moieties disclosed herein are suitable for use in conjunction with an antibody. The term "antibody" is used herein in its broadest sense and includes certain types of immunoglobulin molecules comprising one or more antigen-binding domains that specifically bind to an antigen or epitope. An antibody specifically includes intact antibodies (e.g., intact immunoglobulins), antibody fragments, and multi-specific antibodies. An antibody is one type of ABP.

In some embodiments, the separation moieties disclosed herein are suitable for use in conjunction with an antigen binding protein comprising an alternative scaffold. The term "alternative scaffold" refers to a molecule in which one or more regions may be diversified to produce one or more antigen-binding domains that specifically bind to an antigen or epitope.

In some embodiments, the antigen-binding domain binds the antigen or epitope with specificity and affinity similar to that of an antibody. Exemplary alternative scaffolds include those derived from fibronectin (e.g., Adnectins™), the β-sandwich (e.g., iMab), lipocalin (e.g., Anticalins®), EETI-II/AGRP, BPTI/LACI-D1/ITI-D2 (e.g., Kunitz domains), thioredoxin peptide aptamers, protein A (e.g., Affibody®), ankyrin repeats (e.g., DARPins), gamma-B-crystallin/ubiquitin (e.g., Affilins), CTLD3 (e.g., Tetranectins), Fynomers, and (LDLR-A module) (e.g., Avimers). Additional information on alternative scaffolds is provided in Binz et al., Nat. Biotechnol., 2005 23:1257-1268; Skerra, Current Opin. in Biotech., 2007 18:295-304; and Silacci et al., J. Biol. Chem., 2014, 289:14392-14398; each of which is incorporated by reference in its entirety. An alternative scaffold is one type of ABP.

In some embodiments, the separation moieties disclosed herein are suitable for use in conjunction with an antibody fragment. An "antibody fragment" comprises a portion of an intact antibody, such as the antigen-binding or variable region of an intact antibody. Antibody fragments include, for example, Fv fragments, Fab fragments, F(ab')2 fragments, Fab' fragments, scFv (sFv) fragments, and scFv-Fc fragments.

In some embodiments, the separation moieties disclosed herein are suitable for use in conjunction with one or more Fv, Fab, or F(ab')2 fragments. "Fv" fragments comprise a non-covalently-linked dimer of one heavy chain variable domain and one light chain variable domain. "Fab" fragments comprise, in addition to the heavy and light chain variable domains, the constant domain of the light chain and the first constant domain (CH1) of the heavy chain. Fab fragments may be generated, for example, by recombinant methods or by papain digestion of a full-length antibody. "F(ab')2" fragments contain two Fab' fragments joined, near the hinge region, by disulfide bonds. F(ab')2 fragments may be generated, for example, by recombinant methods or by pepsin digestion of an intact antibody. The F(ab') fragments can be dissociated, for example, by treatment with 1-mercaptoethanol.

In some embodiments, the separation moieties disclosed herein are suitable for use in conjunction with an scFv or scFv-Fc. "Single-chain Fv" or "sFv" or "scFv" antibody fragments comprise a VH domain and a VL domain in a single polypeptide chain. The VH and VL are generally linked by a peptide linker. See Pluckthun A. (1994). Any suitable linker may be used.

In some embodiments, the linker is a (GGGGS)n (SEQ ID NO: 231). In some embodiments, n=1, 2, 3, 4, 5, or 6. See Antibodies from *Escherichia coli*. In Rosenberg M. & Moore G. P. (Eds.), The Pharmacology of Monoclonal Antibodies vol. 113 (pp. 269-315). Springer-Verlag, New York, incorporated by reference in its entirety. "scFv-Fc" fragments comprise an scFv attached to an Fc domain. For example, an Fc domain may be attached to the C-terminal of the scFv. The Fc domain may follow the VH or VL, depending on the orientation of the variable domains in the scFv (i.e., VH-VL or VL-VH). Any suitable Fc domain known in the art or described herein may be used. In some cases, the Fc domain comprises an IgG4 Fc domain.

In some embodiments, the separation moieties disclosed herein are suitable for use in conjunction with a single domain antibody. The term "single domain antibody" refers to a molecule in which one variable domain of an antibody specifically binds to an antigen without the presence of another variable domain. Single domain antibodies, and fragments thereof, are described in Arabi Ghahroudi et al., FEBS Letters, 1998, 414:521-526 and Muyldermans et al., Trends in Biochem. Sci., 2001, 26:230-245, each of which is incorporated by reference in its entirety. Single domain antibodies are also known as sdAbs or nanobodies.

In some embodiments, the separation moieties disclosed herein are suitable for use in conjunction with a monospecific ABP. A "monospecific ABP" is an ABP that comprises one or more binding sites that specifically bind to the same epitope. An example of a mono specific ABP is a naturally occurring IgG molecule which, while divalent (i.e., having two antigen-binding domains), recognizes the same epitope at each of the two antigen-binding domains. The binding specificity may be present in any suitable valency.

In some embodiments, the separation moieties disclosed herein are suitable for use in conjunction with a monoclonal antibody. The term "monoclonal antibody" refers to an antibody from a population of substantially homogeneous antibodies. A population of substantially homogeneous antibodies comprises antibodies that are substantially similar and that bind the same epitope(s), except for variants that may normally arise during production of the monoclonal antibody. Such variants are generally present in only minor amounts. A monoclonal antibody is typically obtained by a process that includes the selection of a single antibody from a plurality of antibodies. For example, the selection process can be the selection of a unique clone from a plurality of clones, such as a pool of hybridoma clones, phage clones, yeast clones, bacterial clones, or other recombinant DNA clones. The selected antibody can be further altered, for example, to improve affinity for the TNFR superfamily member proteins ("affinity maturation"), to humanize the antibody, to improve its production in cell culture, and/or to reduce its immunogenicity in a subject.

In some embodiments, the separation moieties disclosed herein are suitable for use in conjunction with a chimeric antibody. The term "chimeric antibody" refers to an antibody in which a portion of the heavy and/or light chain is derived from a particular source or species, while the remainder of the heavy and/or light chain is derived from a different source or species.

In some embodiments, the separation moieties disclosed herein are suitable for use in conjunction with a humanized antibody. "Humanized" forms of non-human antibodies are chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody Humanized antibodies may also comprise residues that are not found in either the recipient antibody or the donor antibody. Such modifications may be made to further refine antibody function. For further details, see Jones et al., Nature, 1986, 321:522-525; Riechmann et al., Nature, 1988, 332:323-329; and Presta, Curr. Op. Struct. Biol., 1992, 2:593-596, each of which is incorporated by reference in its entirety.

In some embodiments, the separation moieties disclosed herein are suitable for use in conjunction with a human antibody. A "human antibody" is one which possesses an amino acid sequence corresponding to that of an antibody produced by a human or a human cell, or derived from a non-human source that utilizes a human antibody repertoire or human antibody-encoding sequences (e.g., obtained from human sources or designed de novo). Human antibodies specifically exclude humanized antibodies.

In some embodiments, the ABPs provided herein specifically bind to the extracellular domain of a TNFR Superfamily Protein. In some embodiments, the TNFR superfamily protein is CD27, CD137, CD40, GITR, LT-betaR, CD30, HVEM, TNFR1, TNFR2, or OX-40. The TNFR superfamily protein may be expressed on the surface of any suitable target cell. In some embodiments, the target cell is a T cell. In some embodiments, the target cell is an effector T cell. In some embodiments, the target cell is a regulatory T cell. In some embodiments, the target cell is a natural killer (NK) cell. In some embodiments, the target cell is a natural killer T (NKT) cell. In some embodiments, the target cell is a B cell. In some embodiments, the target cell is a myeloid derived cell. In some embodiments, the target cell is a myeloid derived suppressor cell. In some embodiments, the target cell is a dendritic cell.

In some embodiments, an ABP provided herein is an antibody. In some embodiments, an ABP provided herein is an antibody fragment. In some embodiments, an ABP provided herein is an alternative scaffold.

In some embodiments, the ABPs provided herein comprise an immunoglobulin molecule. In some embodiments, the ABPs provided herein consist of an immunoglobulin molecule. In some embodiments, the ABPs provided herein consist essentially of an immunoglobulin molecule. In some aspects, the immunoglobulin molecule comprises an antibody. In some aspects, the immunoglobulin molecule consists of an antibody. In some aspects, the immunoglobulin molecule consists essentially of an antibody.

In some embodiments, the ABPs provided herein comprise a light chain. In some aspects, the light chain is a kappa light chain. In some aspects, the light chain is a lambda light chain In some embodiments, the ABPs provided herein comprise a heavy chain. In some aspects, the heavy chain is an IgA. In some aspects, the heavy chain is an IgD. In some aspects, the heavy chain is an IgE. In some aspects, the heavy chain is an IgG. In some aspects, the heavy chain is an IgM. In some aspects, the heavy chain is an IgG1. In some aspects, the heavy chain is an IgG2. In some aspects, the heavy chain is an IgG3. In some aspects, the heavy chain is an IgG4. In some aspects, the heavy chain is an IgA1. In some aspects, the heavy chain is an IgA2.

In some embodiments, the separation moieties connect to a further blocking moiety.

In some embodiments, the separation moieties are positioned such that movement of the antigen-binding protein subunits is restricted.

a. Multispecific and Monospecific Multivalent Antigen Binding Proteins

In some embodiments, the separation moieties disclosed herein are suitable for use in conjunction with a multispecific antigen binding protein (ABP). Multispecific ABP's provided herein bind more than one antigen. For instance, a multispecific antibody can bind 2 antigens, 3 antigens, binds 4 antigens, 5 antigens, or more. Alternatively, the multispecific ABP can bind 2 or more different epitopes. When the ABP binds two or more epitopes, the two or more different epitopes may be epitopes on the same antigen (e.g., a single TNFR superfamily protein molecule expressed by a cell) or on different antigens (e.g., different TNFR superfamily member protein molecules expressed by the same cell, or a TNFR superfamily member protein molecule and a non-TNFR Superfamily member protein molecule). In some aspects, a multi-specific ABP binds two different epitopes (i.e., a "bispecific ABP"). In some aspects, a multi-specific ABP binds three different epitopes (i.e., a "trispecific ABP"). In some aspects, a multi-specific ABP binds four different epitopes (i.e., a "quadspecific ABP"). In some aspects, a multi-specific ABP binds five different epitopes (i.e., a "quintspecific ABP"). In some aspects, a multi-specific ABP binds 6, 7, 8, or more different epitopes. Each binding specificity may be present in any suitable valency.

In various embodiments, the antigen binding protein comprises a blocking domain. The separation moiety disclosed herein links the blocking domain to a first antigen binding domain and consequently the blocking domain inhibits (a) binding affinity or avidity of the antigen binding protein on the epitope and/or (b) agonist or antagonist activity of the antigen binding protein on the epitope. Preferably the separation moiety comprises a cleavage site. Upon cleavage of the separation moiety by a disease-specific enzyme (i.e., a protease) (a) the binding affinity or avidity of the antigen binding protein on the epitope and/or (b) agonist or antagonist activity of the antigen binding protein on the epitope is increased. In some embodiments, the antigen binding protein comprises an additional separation moiety that links or connects an additional blocking domain to an antigen binding domain. The additional separation moiety comprises a cleavage site.

In various embodiments, the antigen binding protein comprises an additional blocking domain (e g , a second, third, or fourth blocking domain) that is/are operably linked to an antigen binding domain (e.g., the second, third, or fourth antigen binding domain) by a cleavable separation moiety as disclosed herein. The blocking domain can be a steric blocker or a specific blocker. In some embodiments, the steric blocker is independently selected from the group consisting of a fragment of the extracellular portion of the antibody binding protein, serum albumin, a fragment of serum albumin, and an antibody or antigen binding fragment thereof that binds serum albumin. In some embodiments, the specific blocker is independently selected from a fragment of an antibody or antigen-binding fragment thereof that binds to the first, second, third or fourth antigen binding domain of the antigen binding protein described herein. Preferably, the blocking domain is serum albumin or a fragment thereof, or an antibody or antigen binding fragment thereof that binds serum albumin.

The antigen binding domain may further comprise a third antigen binding domain and a fourth antigen binding domain each with binding specificity for a target antigen. TNFR superfamily target antigens are well known in the art and are encompassed by this disclosure. Exemplary TNFR superfamily members include, but are not limited to CD27, CD30, CD137 (4-1BB), TNFR1 (CD120a), TNFR2 (CD120b), CD40, CD95 (Fas/Apo-1), HVEM, LT-betaR, GITR, nerve growth factor receptor or OX-40 (CD34). Preferred TNFR superfamily target antigens are CD27, CD137, and OX40.

The antigen binding domains with specificity for an antigen can have binding specificity for the same epitope or for a different epitope on the same antigen. For example, the first, second and third antigen binding domains can have binding specificity for the same epitope, for a different epitope, two of the antigen binding domains may binding specificity for the same epitope, or three of the antigen binding domains may have binding specificity for the same epitope. In some embodiments, the antigen binding protein may further comprise a fifth antigen binding domain with specificity for a tumor antigen.

In some embodiments, the antigen binding polypeptide comprises an Fc region. In one format, two antigen binding domains can be located on each end of the Fc region. Another format comprises two antibody arms attached to the N terminus of the Fc region, each arm comprising 2 antigen binding domains. The antigen binding domain can also comprise a half-life extension domain. The half-life extension domain can be albumin, an antigen binding domain that recruits albumin, or an immunoglobulin Fc, or a fragment thereof. In some embodiments, the half-life extension domain is operably linked to the antigen binding polypeptide by a cleavable linker.

The disclosure also relates to an antigen binding protein comprising at least a first polypeptide and a second polypeptide. The first polypeptide comprises at least a portion of an antibody heavy chain constant region and an antibody heavy chain variable region (VH). The second polypeptide comprises at least a portion of an antibody light chain constant region and an antibody light chain variable region (VL). At least one of the first and second polypeptide further comprises a blocking domain that is operably linked to the VH or VL through a protease cleavable linker. The first polypeptide associates with the second polypeptide, and VH and VL form an antigen binding site with binding specificity for a target antigen (e.g., 4-1BB or CS27). The blocking domain inhibits binding of the antigen binding site to the target antigen (e.g., 4-1BB or CD27). In some embodiments, the first polypeptide further comprises a second VH, and the first polypeptide associates with two of said second polypeptides to form two VH/VL antigen binding sites that each have specificity for human 4-1BB. In some embodiments, the antigen binding protein is a dimer of the first polypeptide with the associated second polypeptides. The antigen binding protein can further comprise a third, fourth, fifth, or a sixth polypeptide.

In some embodiments the ABP is monospecific multivalent ABP. Such formats can have a variety of structures and be prepared using suitable antibody engineering techniques. For example, a dual Fab antibody that contains a heavy chain with the structure VH-CH1-noncleavable liner-VH-CH1-CH2-CH3 can be prepare. Such a heavy chain can be expressed and can pair with two light chains. The heavy chain can dimerize through conventional interchain disulfide bonds to form an antibody format that contains 4 Fab antigen binding sites. In such formats, the separation moieties described herein can be bonded to the amino terminus of the light chain polypeptides to link a blocker to each of the Fab antigen binding sites. Other suitable monospecific, multivalent ABP formats can be readily envisioned by those of skill in the art. In one such example a heavy chain is prepared that has the structure VH-CH1-CH2-CH3-VH-CH1. Two such heavy chains and dimerize and associate with four light chains to form a monospecific tetravalent ABP format. In such formats, the separation moieties described herein can be bonded to the amino terminus of the light chain polypeptides to link a blocker to each of the Fab antigen binding sites. The binding activity of such monospecific tetravalent ABPs is masked by the blocking domain, and the mask is removed upon cleavage of the separation domain (e.g., in a tumor microenvironment) and the ABP is able to bind its cognate antigen.

The monospecific multivalent ABP formats can have binding specificity for any desired antigen. In some embodiments, the monospecific multivalent ABP formats specifically bind to the extracellular domain of a TNFR Superfamily Protein, such as CD27, CD30, CD137 (4-1BB), TNFR1 (CD120a), TNFR2 (CD120b), CD40, CD95 (Fas/Apo-1), HVEM, LT-betaR, GITR, nerve growth factor receptor or OX-40 (CD34).

In embodiments, the multivalent antigen binding protein can comprise a first antigen binding site with specificity for a target antigen (e.g., CD27 or TNFR1), second antigen binding site with specificity for the target antigen, a blocking polypeptide, at least one protease cleavable linker, and an optional half-life extension element. In such embodiments, a first blocking polypeptide is operably linked to the first antigen binding site by a protease cleavable linker and, optionally, a second blocking polypeptide is operably linked to the second antigen binding site by a protease cleavable linker. Preferably, the blocking polypeptide is operably linked to the second antigen binding site by a protease cleavable linker. The blocking polypeptide inhibits (a) binding affinity or avidity of the antigen binding protein on the target antigen and/or (b) agonist or antagonist activity of the antigen binding protein on the target antigen and upon cleavage of the protease cleavable linker (a) the binding affinity or avidity of the antigen binding protein on the target antigen and/or (b) agonist activity of the antigen binding protein on the target antigen is increased. The optional half-life extension element can be operably linked to the first antigen binding site and/or second antigen binding site through a optionally protease cleavable linker. In such embodiments, the first and second binding sites can have specificity for the same epitope or different epitopes.

In embodiments, the antigen binding protein further comprises a third antigen binding site with specificity for the same target antigen. The antigen binding protein can further comprise a fourth antigen binding site with specificity for the same target antigen as the first and second and third antigen binding sites. The third and fourth antigen binding sites can each further comprise a blocking polypeptide that is operable linked to the antigen-binding sight through a protease clevable linker.

This disclosure also relates to a tetravalent antigen binding protein that can comprise a first polypeptide that comprises at least a portion of an antibody heavy chain constant region and an antibody heavy chain variable region (VH) and a second polypeptide that comprises at least a portion of an antibody light chain constant region, an antibody light chain variable region (VL). The first polypeptide associates with the second polypeptide and the VH and VL form an antigen binding site with binding specificity for a target antigen. The tetravalent antigen binding protein further comprises a blocking polypeptide that is operably linked to the VH or VL through a protease cleavable linker. The blocking polypeptide inhibits binding of the antigen binding site to the target antigen. In some embodiments, the first polypeptide can further comprise a second VH. The first polypeptide associates with two of the second polypeptides to form two VH/VL antigen binding site that each have specificity for the target antigen.

The tetravalent antigen binding protein can further comprise a third polypeptide, a fourth polypeptide, a fifth polypeptide, a sixth polypeptide, a seventh polypeptide, and an eight polypeptide. The third polypeptide can comprise at least a portion of an antibody heavy chain constant region and an antibody heavy chain variable region (VH). The fourth polypeptide can comprise at least a portion of an antibody light chain constant region, an antibody light chain variable region (VL). The firth polypeptide can comprise at least portion of an antibody heavy chain constant region and an antibody heavy chain variable region (VH). The sixth polypeptide can comprise at least a portion of an antibody light chain constant region, an antibody light chain variable region (VL). The seventh polypeptide can comprise at least portion of an antibody heavy chain constant region and an antibody heavy chain variable region (VH). The eighth polypeptide can comprise at least a portion of an antibody light chain constant region, an antibody light chain variable region (VL).

In some embodiments at least one of the third and fourth polypeptide further comprises a blocking polypeptide that is operably linked to the VH or VL through a protease cleavable linker. The third polypeptide associates with the fourth polypeptide and VH and VL form an antigen binding site with binding specificity for a target antigen, and the blocking domain inhibits binding of the antigen binding site to the target antigen.

In some embodiments, the fifth and sixth polypeptide further comprises a blocking polypeptide that is operably linked to the VH or VL through a protease cleavable linker. The fifth polypeptide associates with the sixth polypeptide and VH and VL form an antigen binding site with binding specificity for a target antigen, and the blocking domain inhibits binding of the antigen binding site to the target antigen.

In some embodiments, the seventh and eighth polypeptide further comprises a blocking polypeptide that is operably linked to the VH or VL through a protease cleavable linker. The seventh polypeptide associates with the eighth polypeptide and VH and VL form an antigen binding site with binding specificity for a target antigen, and the blocking domain inhibits binding of the antigen binding site to the target antigen.

vi. Inducible Cytokines

Disclosed herein are methods and compositions to engineer and use constructs comprising inducible cytokines. Cytokines are potent immune agonists, which lead to them being considered promising therapeutic agents for oncology. However, cytokines have a very narrow therapeutic window. Cytokines have short serum half-lives and are also considered to be highly potent. Consequently, therapeutic administration of cytokines produces undesirable systemic effects and toxicities. These were exacerbated by the need to administer large quantities of cytokine in order to achieve the desired levels of cytokine at the intended site of cytokine action (e.g., a tumor). Unfortunately, due to the biology of cytokines and inability to effectively target and control their activity, cytokines have not achieved the hoped-for clinical advantages in the treatment of tumors.

Disclosed herein are fusion proteins that overcome the toxicity and short half-life problems that have severely limited the clinical use of cytokines in oncology. The fusion proteins contain cytokine polypeptides that have receptor agonist activity. But in the context of the fusion protein, the cytokine receptor agonist activity is attenuated, and the circulating half-life is extended. The fusion proteins include protease cleave sites, which are cleaved by proteases that are associated with a desired site of cytokine activity (e.g., a tumor), and are typically enriched or selectively present at the site of desired activity. Thus, the fusion proteins are preferentially (or selectively) and efficiently cleaved at the desired site of activity to limit cytokine activity substantially to the desired site of activity, such as the tumor microenvironment. Protease cleavage at the desired site of activity, such as in a tumor microenvironment, releases a form of the cytokine from the fusion protein that is much more active as a cytokine receptor agonist than the fusion protein (typically at least about 100× more active than the fusion protein). The form of the cytokine that is released upon cleavage of the fusion protein typically has a short half-life, which is often substantially similar to the half-life of the naturally occurring cytokine, further restricting cytokine activity to the tumor microenvironment. Even though the half-life of the fusion protein is extended, toxicity is dramatically reduced or eliminated because the circulating fusion protein is attenuated, and active cytokine is targeted to the tumor microenvironment. The fusion proteins described herein, for the first time, enable the administration of an effective therapeutic dose of a cytokine to treat tumors with the activity of the cytokine substantially limited to the tumor microenvironment, and dramatically reduces or eliminates unwanted systemic effects and toxicity of the cytokine.

In general, the therapeutic use of cytokines is strongly limited by their systemic toxicity. TNF, for example, was originally discovered for its capacity of inducing the hemorrhagic necrosis of some tumors, and for its in vitro cytotoxic effect on different tumoral lines, but it subsequently proved to have strong pro-inflammatory activity, which can, in case of overproduction conditions, dangerously affect the human body. As the systemic toxicity is a fundamental problem with the use of pharmacologically active amounts of cytokines in humans, novel derivatives and therapeutic strategies are now under evaluation, aimed at reducing the toxic effects of this class of biological effectors while keeping their therapeutic efficacy.

IL-2 exerts both stimulatory and regulatory functions in the immune system and is, along with other members of the common γ chain (γc) cytokine family, central to immune homeostasis. IL-2 mediates its action by binding to IL-2 receptors (IL-2R), consisting of either trimeric receptors made of IL-2Rα (CD25), IL-2Rβ (CD122), and IL-2Rγ (γc, CD132) chains or dimeric βγ IL-2Rs (1, 3). Both IL-2R variants are able to transmit signal upon IL-2 binding. However, trimeric αβγ IL-2Rs have a roughly 10-100 times higher affinity for IL-2 than dimeric βγ IL-2Rs (3), implicating that CD25 confers high-affinity binding of IL-2 to its receptor but is not crucial for signal transduction. Trimeric IL-2Rs are found on activated T cells and CD4+ forkhead box P3 (FoxP3)+T regulatory cells (Treg), which are sensitive to IL-2 in vitro and in vivo. Conversely, antigen-experienced (memory) CD8+, CD44 high memory-phenotype (MP) CD8+, and natural killer (NK) cells are endowed with high levels of dimeric βγ IL-2Rs, and these cells also respond vigorously to IL-2 in vitro and in vivo.

Expression of the high-affinity IL-2R is critical for endowing T cells to respond to low concentrations of IL-2 that is transiently available in vivo. IL-2Rα expression is absent on naive and memory T cells but is induced after antigen activation. IL-2Rβ is constitutively expressed by NK, NKT, and memory CD8+ T cells but is also induced on naive T cells after antigen activation. γc is much less stringently regulated and is constitutively expressed by all lymphoid cells. Once the high-affinity IL-2R is induced by antigen, IL-2R signaling upregulates the expression of IL-2Rα in part through Stat5-dependent regulation of Il2ra transcription (Kim et al., 2001). This process represents a mechanism to maintain expression of the high-affinity IL-2R and sustain IL-2 signaling while there remains a source of IL-2.

IL-2 is captured by IL-2Rα through a large hydrophobic binding surface surrounded by a polar periphery that results in a relatively weak interaction (Kd 10-8 M) with rapid on-off binding kinetics. However, the IL-2Rα-IL-2 binary complex leads to a very small conformational change in IL-2 that promotes association with IL-2Rβ through a distinct polar interaction between IL-2 and IL-2Rβ. The pseudo-high affinity of the IL2/αβ trimeric complex (i.e. Kd ~300 pM) clearly indicates that the trimeric complex is more stable than either IL2 bound to the α chain alone (Kd=10 nM) or to the β chain alone (Kd=450 nM). In any event, the IL2/αβ trimer then recruits the γ chain into the quaternary complex capable of signaling, which is facilitated by the large composite binding site on the IL2-bound β chain for the κ chain.

In other words, the ternary IL-2Rα-IL-2Rβ-IL-2 complex then recruits γc through a weak interaction with IL-2 and a stronger interaction with IL-2Rβ to produce a stable quaternary high-affinity IL-2R (Kd 10-11 M which is 10 pM). The formation of the high-affinity quaternary IL-2-IL-2R complex leads to signal transduction through the tyrosine kinases Jak1 and Jak3, which are associated with IL-2Rβ and γc, respectively (Nelson and Willerford, 1998). The quaternary IL-2-IL-2R complex is rapidly internalized, where IL-2, IL-2Rβ, and γc are rapidly degraded, but IL-2Ra is recycled to the cell surface (Hemar et al., 1995; Yu and Malek, 2001). Thus, those functional activities that require sustained IL-2R signaling require a continued source of IL-2 to engage IL-2Rα and form additional IL-2-IL-2R signaling complexes.

Interleukin-15 (IL-15), another member of the 4-alpha-helix bundle family of cytokines, has also emerged as an immunomodulator for the treatment of cancer. IL-15 is initially captured via IL-15Ra, which is expressed on antigen-presenting dendritic cells, monocytes and macrophages. IL-15 exhibits broad activity and induces the differentiation and proliferation of T, B and natural killer (NK) cells via signaling through the IL-15/IL-2-R-β (CD122) and the common γ chain (CD132). It also enhances cytolytic activity of CD8+ T cells and induces long-lasting antigen-experienced CD8$^+$CD44 memory T cells. IL-15 stimulates differentiation and immunoglobulin synthesis by B cells and induces maturation of dendritic cells. It does not stimulate immunosuppressive T regulatory cells (Tregs). Thus, boosting IL-15 activity selectively in the tumor micro-environment could enhance innate and specific immunity and fight tumors (Waldmann et al., 2012). IL-15 was initially identified for its ability to stimulate T cell proliferation in an IL-2-like manner through common receptor components (IL-2R/15Rβ-γc) and signaling through JAK1/JAK3 and STAT3/STAT5. Like IL-2, IL-15 has been shown to stimulate proliferation of activated CD4-CD8−, CD4+CD8+, CD4+ and CD8+ T cells as well as facilitate the induction of cytotoxic T-lymphocytes, and the generation, proliferation and activation of NK cells (Waldmann et al., 1999). However, unlike IL-2 which is required to maintain forkhead box P3 (FOXP3)-expressing CD4+CD25+ Treg cells and for the retention of these cells in the periphery, IL-15 has little effect on Tregs (Berger et al., 2009). This is important as FOXP3-expressing CD4+CD25+ Tregs inhibit effector T cells, thereby inhibiting immune responses including those directed against the tumor. IL-2 also has a crucial role in initiating activation induced cell death (AICD), a process that leads to the elimination of self-reactive T cells, whereas IL-15 is an anti-apoptotic factor for T cells (Marks-Konczalik et al., 2000). IL-15 co-delivered with HIV peptide vaccines has been shown to overcome CD4+ T cell deficiency by promoting longevity of antigen-specific CD8+ T cells and blocking TRAIL-mediated apoptosis (Oh et al., 2008). Furthermore, IL-15 promotes the long-term maintenance of CD8+CD44hi memory T cells (Kanegane et al., 1996).

The importance of IL-15 and IL-15Ra to T and NK cell development is further highlighted by the phenotype of IL-15R$\alpha^{-/-}$ and IL-15$^{-/-}$ mice. Knockout mice demonstrate decreased numbers of total CD8+ T cells, and are deficient in memory-phenotype CD8+ T cells, NK cells, NK/T cells and some subsets of intestinal intraepithelial lymphocytes, indicating that IL-15 provides essential positive homeostatic functions for these subsets of cells (Lodolce et al., 1996; Kennedy et al., 1998). The similarities in the phenotypes of these two strains of knockout mice suggest the importance of IL-15Ra in maintaining physiologically relevant IL-15 signals.

IL-15 is presented in trans by the IL-15 receptor alpha-chain to the IL-15R$\beta\gamma$c complex displayed on the surface of T cells and natural killer (NK) cells (Han et al., 2011). The IL-15Ra-chain plays a role of chaperone protein, stabilizes, and increases IL-15 activity (Desbois et al., 2016). It has been shown that exogenous IL-15 may have a limited impact on patients with cancer due to its dependency on IL-15Ra frequently downregulated in cancer patients. Therefore, the fusion protein RLI, composed of the sushi+ domain of IL15Ra coupled via a linker to IL-15, has been suggested as an alternative approach to IL15 therapy (Bessard et al., 2009). It was found that administration of soluble IL-15/IL-15Ra complexes greatly enhanced IL-15 serum half-life and bioavailability in vivo (Stoklasek et al., 2010).

In addition to the effects on T and NK cells, IL-15 also has several effects on other components of the immune system. IL-15 protects neutrophils from apoptosis, modulates phagocytosis and stimulates the secretion of IL-8 and IL-1R antagonist. It functions through the activation of JAK2, p38 and ERK1/2 MAPK, Syk kinase and the NF-kB transcriptional factor (Pelletier et al., 2002). In mast cells, IL-15 can act as a growth factor and an inhibitor of apoptosis. In these cells IL-15 activates the JAK2/STAT5 pathway without the requirement of $\gamma$c binding (Tagaya et al., 1996). IL-15 also induces B lymphocyte proliferation and differentiation, and increases immunoglobulin secretion (Armitage et al., 1995). It also prevents Fas-mediated apoptosis and allows induction of antibody responses partially independent of CD4-help (Demerci et al., 2004; Steel et al., 2010). Monocytes, macrophages and dendritic cells effectively transcribe and translate IL-15. They also respond to IL-15 stimulation. Macrophages respond by increasing phagocytosis, inducing IL-8, IL-12 and MCP-1 expression, and secreting IL-6, IL-8 and TNF$\alpha$ (Budagian et al., 2006). Dendritic cells incubated with IL-15 demonstrate maturation with increased CD83, CD86, CD40, and MHC class II expression, are also resistant to apoptosis, and show enhanced interferon-$\gamma$ secretion (Anguille et al., 2009).

IL-15 has also been shown to have effects on non-hematological cells including myocytes, adipocytes, endothelial and neural cells. IL-15 has an anabolic effect on muscle and may support muscle cell differentiation (Quinn et al., 1995). It stimulates myocytes and muscle fibers to accumulate contractile protein and is able to slow muscle wasting in rats with cancer-related cachexia (Figueras et al., 2004). IL-15 has also been shown to stimulate angiogenesis (Angiolillo et al., 1997) and induce microglial growth and survival (Hanisch et al., 1997).

Interleukin-7 (IL-7), also of the IL-2/IL-15 family, is a well-characterized pleiotropic cytokine, and is expressed by stromal cells, epithelial cells, endothelial cells, fibroblasts, smooth muscle cells and keratinocytes, and following activation, by dendritic cells (Alpdogan et al., 2005). Although it was originally described as a growth and differentiation factor for precursor B lymphocytes, subsequent studies have shown that IL-7 is critically involved in T-lymphocyte development and differentiation. Interleukin-7 signaling is essential for optimal CD8 T-cell function, homeostasis and establishment of memory (Schluns et al., 2000); it is required for the survival of most T-cell subsets, and its expression has been proposed to be important for regulating T-cell numbers.

IL-7 binds to a dimeric receptor, including IL-7R$\alpha$ and $\gamma_c$ to form a ternary complex that plays fundamental roles in extracellular matrix remodeling, development, and homeostasis of T and B cells (Mazzucchelli and Durum, 2007). IL-7R$\alpha$ also cross-reacts to form a ternary complex with thymic stromal lymphopoietin (TSLP) and its receptor (TSLPR), and activates the TSLP pathway, resulting in T and dendritic cell proliferation in humans and further B cell development in mice (Leonard, 2002). Tight regulation of the signaling cascades activated by the complexes are therefore crucial to normal cellular function. Under-stimulation of the IL-7 pathway caused by mutations in the IL-7Ra ectodomain inhibits T and B cell development, resulting in patients with a form of severe combined immunodeficiency (SCID) (Giliani et al., 2005; Puel et al., 1998).

IL-7 has a potential role in enhancing immune reconstitution in cancer patients following cytotoxic chemotherapy. IL-7 therapy enhances immune reconstitution and can augment even limited thymic function by facilitating peripheral expansion of even small numbers of recent thymic emigrants. Therefore, IL-7 therapy could potentially repair the immune system of patients who have been depleted by cytotoxic chemotherapy (Capitini et al., 2010).

Interleukin-12 (IL-12) is a disulfide-linked heterodimer of two separately encoded subunits (p35 and p40), which are linked covalently to give rise to the so-called bioactive heterodimeric (p70) molecule (Lieschke et al., 1997; Jana et al., 2014). Apart from forming heterodimers (IL-12 and IL-23), the p40 subunit is also secreted as a monomer (p40) and a homodimer (p40$_2$). It is known in the art that synthesis of the heterodimer as a single chain with a linker connecting the p35 to the p40 subunit preserves the full biological activity of the heterodimer. IL-12 plays a critical role in the early inflammatory response to infection and in the generation of Th1 cells, which favor cell-mediated immunity. It has been found that overproduction of IL-12 can be dangerous to the host because it is involved in the pathogenesis of a number of autoimmune inflammatory diseases (e.g. MS, arthritis, type 1 diabetes).

The IL-12 receptor (IL-12R) is a heterodimeric complex consisting of IL-12R$\beta$1 and IL-12R$\beta$2 chains expressed on the surface of activated T-cells and natural killer cells (Trinchieri et al., 2003). The IL-12R$\beta$1 chain binds to the IL-12p40 subunit, whereas IL-12p35 in association with IL-12R$\beta$2 confers an intracellular signaling ability (Benson et al., 2011). Signal transduction through IL-12R induces phosphorylation of Janus kinase (Jak2) and tyrosine kinase (Tyk2), that phosphorylate and activate signal transducer and activator of transcription (STAT)1, STAT3, STAT4, and STAT5. The specific cellular effects of IL-12 are due mainly to activation of STAT4. IL-12 induces natural killer and T-cells to produce cytokines, in particular interferon (IFN)$\gamma$, that mediate many of the proinflammatory activities of IL-12, including CD4+ T-cell differentiation toward the Th1 phenotype (Montepaone et al., 2014).

Treg cells actively suppress activation of the immune system and prevent pathological self-reactivity and consequent autoimmune disease. Developing drugs and methods to selectively activate regulatory T cells for the treatment of autoimmune disease is the subject of intense research and, until the development of the present invention, which can selectively deliver active interleukins at the site of inflammation, has been largely unsuccessful. Treg are a class of CD4+CD25+ T cells that suppress the activity of other immune cells. Treg are central to immune system homeostasis and play a major role in maintaining tolerance to self-antigens and in modulating the immune response to foreign antigens. Multiple autoimmune and inflammatory diseases, including Type 1 Diabetes (T1D), Systemic Lupus Erythematosus (SLE), and Graft-versus-Host Disease (GVHD) have been shown to have a deficiency of Treg cell numbers or Treg function.

Consequently, there is great interest in the development of therapies that boost the numbers and/or function of Treg cells. One treatment approach for autoimmune diseases being investigated is the transplantation of autologous, ex vivo-expanded Treg cells (Tang, Q., et al, 2013, Cold Spring Harb. Perspect. Med., 3:1-15). While this approach has shown promise in treating animal models of disease and in several early stage human clinical trials, it requires personalized treatment with the patient's own T cells, is invasive, and is technically complex. Another approach is treatment with low dose Interleukin-2 (IL-2). Treg cells characteristically express high constitutive levels of the high affinity IL-2 receptor, IL2R$\alpha\beta\gamma$, which is composed of the subunits IL2R$\alpha$ (CD25), IL2R$\beta$ (CD122), and IL2R$\gamma$ (CD132), and Treg cell growth has been shown to be dependent on IL-2 (Malek, T. R., et al., 2010, Immunity, 33:153-65).

Conversely, immune activation has also been achieved using IL-2, and recombinant IL-2 (Proleukin®) has been approved to treat certain cancers. High-dose IL-2 is used for the treatment of patients with metastatic melanoma and metastatic renal cell carcinoma with a long-term impact on overall survival.

Clinical trials of low-dose IL-2 treatment of chronic GVHD (Koreth, J., et al., 2011, N Engl J Med., 365:2055-66) and HCV-associated autoimmune vasculitis patients (Saadoun, D., et al., 2011, N Engl J Med., 365:2067-77) have demonstrated increased Treg levels and signs of clinical efficacy. New clinical trials investigating the efficacy of IL-2 in multiple other autoimmune and inflammatory diseases have been initiated. The rationale for using so-called low dose IL-2 was to exploit the high IL-2 affinity of the trimeric IL-2 receptor which is constitutively expressed on Tregs while leaving other T cells which do not express the high affinity receptor in the inactivated state. Aldesleukin (marketed as Proleukin® by Prometheus Laboratories, San Diego, Calif.), the recombinant form of IL-2 used in these trials, is associated with high toxicity. Aldesleukin is approved for the treatment of metastatic melanoma and metastatic renal cancer, but its side effects are so severe that its use is only recommended in a hospital setting with access to intensive care (Web address: www.proleukin com/assets/pdf/proleukin.pdf).

The clinical trials of IL-2 in autoimmune diseases have employed lower doses of IL-2 in order to target Treg cells, because Treg cells respond to lower concentrations of IL-2 than many other immune cell types due to their expression of IL2R alpha (Klatzmann D, 2015 Nat Rev Immunol. 15:283-94). However, even these lower doses resulted in safety and tolerability issues, and the treatments used have employed daily subcutaneous injections, either chronically or in intermittent 5-day treatment courses. Therefore, there is a need for an autoimmune disease therapy that potentiates Treg cell numbers and function, that targets Treg cells more specifically than IL-2, that is safer and more tolerable, and that is administered less frequently.

One approach that has been suggested for improving the therapeutic index of IL-2-based therapy is to use variants of IL-2 that are selective for Treg cells relative to other immune cells. IL-2 receptors are expressed on a variety of different immune cell types, including T cells, NK cells, eosinophils, and monocytes, and this broad expression pattern likely contributes to its pleiotropic effect on the immune system and high systemic toxicity. In particular, activated T effector cells express IL2R$\alpha\beta\gamma$, as do pulmonary epithelial cells. But, activating T effector cells runs directly counter to the goal of down-modulating and controlling an immune response, and activating pulmonary epithelial cells leads to known dose-limiting side effects of IL-2 including pulmonary edema. In fact, the major side effect of high-dose IL-2 immunotherapy is vascular leak syndrome (VLS), which leads to accumulation of intravascular fluid in organs such as lungs and liver with subsequent pulmonary edema and liver cell damage. There is no treatment of VLS other than withdrawal of IL-2. Low-dose IL-2 regimens have been tested in patients to avoid VLS, however, at the expense of suboptimal therapeutic results.

According to the literature, VLS is believed to be caused by the release of proinflammatory cytokines from IL-2-activated NK cells. However, there is strong evidence that pulmonary edema results from direct binding of IL-2 to lung endothelial cells, which expressed low to intermediate levels of functional $\alpha\beta\gamma$ IL-2Rs. And, the pulmonary edema associated with interaction of IL-2 with lung endothelial cells was abrogated by blocking binding to CD25 with an anti-CD25 monoclonal antibody (mAb), in CD25-deficient host mice, or by the use of CD122-specific IL-2/anti-IL-2 mAb (IL-2/mAb) complexes, thus preventing VLS.

Treatment with interleukin cytokines other than IL-2 has been more limited. IL-15 displays immune cell stimulatory activity similar to that of IL-2 but without the same inhibitory effects, thus making it a promising immunotherapeutic candidate. Clinical trials of recombinant human IL-15 for the treatment of metastatic malignant melanoma or renal cell cancer demonstrated appreciable changes in immune cell distribution, proliferation, and activation and suggested potential antitumor activity (Conlon et. al., 2014). IL-15 is currently in clinical trials to treat various forms of cancer. However, IL-15 therapy is known to be associated with undesired and toxic effects, such as exacerbating certain leukemias, graft-versus-host disease, hypotension, thrombocytopenia, and liver injury. (Mishra A., et al., Cancer Cell, 2012, 22(5):645-55; Alpdogan O. et al., Blood, 2005, 105 (2):866-73; Conlon KC et al., J Clin Oncol, 2015, 33(1): 74-82.)

IL-7 promotes lymphocyte development in the thymus and maintains survival of naive and memory T cell homeostasis in the periphery. Moreover, it is important for the organogenesis of lymph nodes (LN) and for the maintenance of activated T cells recruited into the secondary lymphoid organs (SLOB) (Gao et. al., 2015). In clinical trials of IL-7, patients receiving IL-7 showed increases in both CD4+ and CD8+ T cells, with no significant increase in regulatory T cell numbers as monitored by FoxP3 expression (Sportes et al., 2008). In clinical trials reported in 2006, 2008 and 2010, patients with different kinds of cancers such as metastatic melanoma or sarcoma were injected subcutaneously with different doses of IL-7. Little toxicity was seen except for transient fevers and mild erythema. Circulating levels of both CD4+ and CD8+ T cells increased significantly and the number of Treg reduced. TCR repertoire diversity increased after IL-7 therapy. However, the anti-tumor activity of IL-7 was not well evaluated (Gao et. al., 2015). Results suggest that IL-7 therapy could enhance and broaden immune responses.

IL-12 is a pleiotropic cytokine, the actions of which create an interconnection between the innate and adaptive immunity. IL-12 was first described as a factor secreted from PMA-induced EBV-transformed B-cell lines. Based on its actions, IL-12 has been designated as cytotoxic lymphocyte maturation factor and natural killer cell stimulatory factor. Due to bridging the innate and adaptive immunity and potently stimulating the production of IFNγ, a cytokine coordinating natural mechanisms of anticancer defense, IL-12 seemed ideal candidate for tumor immunotherapy in humans. However, severe side effects associated with systemic administration of IL-12 in clinical investigations and the very narrow therapeutic index of this cytokine markedly tempered enthusiasm for the use of this cytokine in cancer patients (Lasek et. al., 2014). Approaches to IL-12 therapy in which delivery of the cytokine is tumor-targeted, which may diminish some of the previous issues with IL-12 therapy, are currently in clinical trials for cancers.

The direct use of IL-2 as an agonist to bind the IL-2R and modulate immune responses therapeutically has been problematic due its well-documented therapeutic risks, e.g., its short serum half-life and high toxicity. These risks have also limited the therapeutic development and use of other cytokines. New forms of cytokines that reduce these risks are needed. Disclosed herein are compositions and methods comprising IL-2 and IL-15 and other cytokines, functional fragments and muteins of cytokines as well as conditionally active cytokines designed to address these risks and provide needed immunomodulatory therapeutics.

The present invention is designed to address the shortcomings of direct IL-2 therapy and therapy using other cytokines, for example using cytokine blocking moieties, e.g. steric blocking polypeptides, serum half-life extending polypeptides, targeting polypeptides, linking polypeptides, including protease cleavable linkers, and combinations thereof. Cytokines, including interleukins (e.g., IL-2, IL-7, IL-12, IL-15, IL-18, IL-21 IL-23), interferons (IFNs, including IFNα, IFNβ and IFNγ), tumor necrosis factors (e.g., TNFα, lymphotoxin), transforming growth factors (e.g., TGFβ1, TGFβ2, TGFβ3), chemokines (C-X-C motif chemokine 10 (CXCL10), CCL19, CCL20, CCL21), and granulocyte macrophage-colony stimulating factor (GM-CS) are highly potent when administered to patients. As used herein, "chemokine" means a family of small cytokines with the ability to induce directed chemotaxis in nearby responsive cells Cytokines can provide powerful therapy but are accompanied by undesired effects that are difficult to control clinically and which have limited the clinical use of cytokines. This disclosure relates to new forms of cytokines that can be used in patients with reduced or eliminated undesired effects. In particular, this disclosure relates to pharmaceutical compositions including chimeric polypeptides (fusion proteins), nucleic acids encoding fusion proteins and pharmaceutical formulations of the foregoing that contain cytokines or active fragments or muteins of cytokines that have decreased cytokine receptor activating activity in comparison to the corresponding cytokine. However, under selected conditions or in a selected biological environment the chimeric polypeptides activate their cognate receptors, often with the same or higher potency as the corresponding naturally occurring cytokine. As described herein, this is typically achieved using a cytokine blocking moiety that blocks or inhibits the receptor activating function of the cytokine, active fragment or mutein thereof under general conditions but not under selected conditions, such as those present at the desired site of cytokine activity (e.g., an inflammatory site or a tumor).

The chimeric polypeptides and nucleic acids encoding the chimeric polypeptides can be made using any suitable method. For example, nucleic acids encoding a chimeric polypeptide can be made using recombinant DNA techniques, synthetic chemistry or combinations of these techniques, and expressed in a suitable expression system, such as in CHO cells. Chimeric polypeptides can similarly be made, for example by expression of a suitable nucleic acid, using synthetic or semi-synthetic chemical techniques, and the like. In some embodiments, the blocking moiety can be attached to the cytokine polypeptide via sortase-mediated conjugation. "Sortases" are transpeptidases that modify proteins by recognizing and cleaving a carboxyl-terminal sorting signal embedded in or terminally attached to a target protein or peptide. Sortase A catalyzes the cleavage of the LPXTG motif (where X is any standard amino acid) (SEQ ID NO: 237) between the Thr and Gly residue on the target protein, with transient attachment of the Thr residue to the active site Cys residue on the enzyme, forming an enzyme-thioacyl intermediate. To complete transpeptidation and create the peptide-monomer conjugate, a biomolecule with an N-terminal nucleophilic group, typically an oligoglycine motif, attacks the intermediate, displacing Sortase A and joining the two molecules.

To form the cytokine-blocking moiety conjugate, the cytokine polypeptide is first tagged at the N-terminus with a polyglycine sequence, or alternatively, with at the C-terminus with a LPXTG (SEQ ID NO: 237) motif. The blocking moiety or other element has respective peptides attached that serve as acceptor sites for the tagged polypeptides. For conjugation to domains carrying a LPXTG (SEQ ID NO: 237) acceptor peptide attached via its N-terminus, the polypeptide will be tagged with an N-terminal poly-glycine stretch. For conjugation to domain carrying a poly-glycine peptide attached via its C-terminus, the polypeptide will be tagged at its C-terminus with a LPXTG (SEQ ID NO: 237) sortase recognition sequence. Recognizing poly-glycine and LPXTG (SEQ ID NO: 237) sequences, sortase will form a peptide bond between polymer-peptide and tagged polypeptides. The sortase reaction cleaves off glycine residues as intermediates and occurs at room temperature.

A variety of mechanisms can be exploited to remove or reduce the inhibition caused by the blocking moiety. For example, the pharmaceutical compositions can include a cytokine moiety and a blocking moiety, e.g. a steric blocking moiety, with a protease cleavable linker comprising a protease cleavage site located between the cytokine and cytokine blocking moiety or within the cytokine blocking moiety. When the protease cleavage site is cleaved, the blocking moiety can dissociate from cytokine, and the cytokine can then activate cytokine receptor.

Any suitable linker can be used. For example, the linker can comprise glycine-glycine, a sortase-recognition motif, or a sortase-recognition motif and a peptide sequence $(Gly_4Ser)_n$ (SEQ ID NO: 238) or $(Gly_3Ser)_n$ (SEQ ID NO: 239), wherein n is 1, 2, 3, 4 or 5. Typically, the sortase-recognition motif comprises a peptide sequence LPXTG (SEQ ID NO: 237), where X is any amino acid. In some embodiments, the covalent linkage is between a reactive lysine residue attached to the C-terminal of the cytokine polypeptide and a reactive aspartic acid attached to the N-terminal of the blocker or other domain. In other embodiments, the covalent linkage is between a reactive aspartic acid residue attached to the N-terminal of the cytokine polypeptide and a reactive lysine residue attached to the C-terminal of the blocker or another domain.

Accordingly, as described in detail herein, the cytokine blocking moieties used can be steric blockers. As used herein, a "steric blocker" refers to a polypeptide or polypeptide moiety that can be covalently bonded to a cytokine polypeptide directly or indirectly through other moieties such as linkers, for example in the form of a chimeric polypeptide (fusion protein), but otherwise does not covalently bond to the cytokine polypeptide. A steric blocker can non-covalently bond to the cytokine polypeptide, for example though electrostatic, hydrophobic, ionic or hydrogen bonding. A steric blocker typically inhibits or blocks the activity of the cytokine moiety due to its proximity to the cytokine moiety and comparative size. The steric inhibition of the cytokine moiety can be removed by spatially separating the cytokine moiety from the steric blocker, such as by enzymatically cleaving a fusion protein that contains a steric blocker and a cytokine polypeptide at a site between the steric blocker and the cytokine polypeptide.

As described in greater detail herein, the blocking function can be combined with or due to the presence of additional functional components in the pharmaceutical composition, such as a targeting domain, a serum half-life extension element, and protease-cleavable linking polypeptides. For example, a serum half-life extending polypeptide can also be a steric blocker.

In the interest of presenting a concise disclosure of the full scope of the invention, aspects of the invention are described in detail using the cytokine IL-2 as an exemplary cytokine. However, the invention and this disclosure are not limited to IL-2. It will be clear to a person of skill in the art that this disclosure, including the disclosed methods, polypeptides and nucleic acids, adequately describes and enables the use of other cytokines, fragments and muteins, such as IL-2, IL-7, IL-12, IL-15, IL-18, IL-21 IL-23, IFNα, IFNβ, IFNγ, TNFα, lymphotoxin, TGF-β1, TGFβ2, TGFβ3, GM-CSF, CXCL10, CCL19, CCL20, CCL21 and functional fragments or muteins of any of the foregoing.

Various elements ensure the delivery and activity of IL-2 preferentially at the site of desired IL-2 activity and to severely limit systemic exposure to the interleukin via a blocking and/or a targeting strategy preferentially linked to a serum half-life extension strategy. In this serum half-life extension strategy, the blocked version of interleukin circulates for extended times (preferentially 1-2 or more weeks) but the activated version has the typical serum half-life of the interleukin By comparison to a serum half-life extended version, the serum half-life of IL-2 administered intravenously is only ~10 minutes due to distribution into the total body extracellular space, which is large, ~15 L in an average sized adult. Subsequently, IL-2 is metabolized by the kidneys with a half-life of ~2.5 hours. (Smith, K. "Interleukin 2 immunotherapy." *Therapeutic Immunology* 240 (2001)). By other measurements, IL-2 has a very short plasma half-life of 85 minutes for intravenous administration and 3.3 hours subcutaneous administration (Kirchner, G. I., et al., 1998, Br J Clin Pharmacol. 46:5-10). In some embodiments of this invention, the half-life extension element is linked to the interleukin via a linker which is cleaved at the site of action (e.g. by inflammation-specific proteases) releasing the interleukin's full activity at the desired site and also separating it from the half-life extension of the uncleaved version. In such embodiments, the fully active and free interleukin would have very different pharmacokinetic (pK) properties—a half-life of hours instead of weeks. In addition, exposure to active cytokine is limited to the site of desired cytokine activity (e.g., an inflammatory site or tumor) and systemic exposure to active cytokine, and associated toxicity and side effects, are reduced.

Other cytokines envisioned in this invention have similar pharmacology (e.g. IL-15 as reported by Blood 2011 117: 4787-4795; doi: doi.org/10.1182/blood-2010-10-311456) as IL-2 and accordingly, the designs of this invention address the shortcomings of using these agents directly, and provide chimeric polypeptides that can have extended half-life and/or be targeted to a site of desired activity (e.g., a site of inflammation or a tumor).

If desired, IL-2 can be engineered to bind the IL-2R complex generally or one of the three IL-2R subunits specifically with an affinity that differs from that of the corresponding wild-type IL-2, for example to selectively activate Tregs or Teff (Effector T Cell). For example, IL-2 polypeptides that are said to have higher affinity for the trimeric form of the IL-2 receptor relative to the dimeric beta/gamma form of the Il-2 receptor in comparison to wild type IL-2 can have an amino acid sequence that includes one of the following sets of mutations with respect to SEQ ID NO: 1 (a mature IL-2 protein comprising amino acids 21-153 of human IL-2 having the UniProt Accession No. P60568-1): (a) K64R, V69A, and Q74P; (b) V69A, Q74P, and T101A; (c) V69A, Q74P, and I128T; (d) N30D, V69A, Q74P, and F103S; (e) K49E, V69A, A73V, and K76E; (f) V69A, Q74P, T101A, and T133N; (g) N30S, V69A, Q74P, and I128A; (h) V69A, Q74P, N88D, and S99P; (i) N30S, V69A, Q74P, and I128T; (j) K9T, Q11R, K35R, V69A, and Q74P; (k) AIT, M46L, K49R, E61D, V69A, and H79R; (l) K48E, E68D, N71T, N90H, F103S, and I114V; (m) S4P, T10A, Q11R, V69A, Q74P, N88D, and T133A; (n) E15K, N30S Y31H, K35R, K48E, V69A, Q74P, and I92T; (o) N30S, E68D, V69A, N71A, Q74P, 575P, K76R, and N90H; (p) N30S, Y31C, T37A, V69A, A73V, Q74P, H79R, and I128T; (q) N26D, N29S, N30S, K54R, E67G, V69A, Q74P, and I92T; (r) K8R, Q13R, N26D, N30T, K35R, T37R, V69A, Q74P, and I92T; and (s) N29S, Y31H, K35R, T37A, K48E, V69A, N71R, Q74P, N88D, and I89V. This approach can also be applied to prepare muteins of other cytokines including interleukins (e.g., IL-2, IL-7, IL-12, IL-15, IL-18, IL-23), interferons (IFNs, including IFNalpha, IFNbeta and IFNgamma), tumor necrosis factors (e.g., TNFalpha, lymphotoxin), transforming growth factors (e.g., TGFbeta1, TGFbeta2, TGFbeta3) and granulocyte macrophage-colony stimulating factor (GM-CS). For example, muteins can be prepared that have desired binding affinity for a cognate receptor.

As noted above, any of the mutant IL-2 polypeptides disclosed herein can include the sequences described; they can also be limited to the sequences described and otherwise identical to SEQ ID NO:1. Moreover, any of the mutant IL-2 polypeptides disclosed herein can optionally include a substitution of the cysteine residue at position 125 with another residue (e.g., serine) and/or can optionally include a deletion of the alanine residue at position 1 of SEQ ID NO:1.

Another approach to improving the therapeutic index of an IL-2 based therapy is to optimize the pharmacokinetics of the molecule to maximally activate Treg cells. Early studies of IL-2 action demonstrated that IL-2 stimulation of human T cell proliferation in vitro required a minimum of 5-6 hours exposure to effective concentrations of IL-2 (Cantrell, D. A., et. al., 1984, Science, 224: 1312-1316). When administered to human patients, IL-2 has a very short plasma half-life of 85 minutes for intravenous administration and 3.3 hours subcutaneous administration (Kirchner, G. I., et al., 1998, Br J Clin Pharmacol. 46:5-10). Because of its short half-life, maintaining circulating IL-2 at or above the level necessary to stimulate T cell proliferation for the necessary duration necessitates high doses that result in peak IL-2 levels significantly above the EC50 for Treg cells or will require frequent administration. These high IL-2 peak levels can activate IL2Rβγ receptors and have other unintended or adverse effects, for example VLS as noted above. An IL-2 analog, or a multifunctional protein with IL-2 attached to a domain that enables binding to the FcRn receptor, with a longer circulating half-life than IL-2 can achieve a target drug concentration for a specified period of time at a lower dose than IL-2, and with lower peak levels. Such an IL-2 analog will therefore require either lower doses or less frequent administration than IL-2 to effectively stimulate Treg cells. Less frequent subcutaneous administration of an IL-2 drug will also be more tolerable for patients. A therapeutic with these characteristics will translate clinically into improved pharmacological efficacy, reduced toxicity, and improved patient compliance with therapy. Alternatively, IL-2 or muteins of IL-2 (herein, "IL-2*") can be selectively targeted to the intended site of action (e.g. sites of inflammation). This targeting can be achieved by one of several strategies, including the addition of domains to the administered agent that comprise blockers of the IL-2 (or muteins) that are cleaved away or by targeting domains or a combination of the two.

In some embodiments, IL-2* partial agonists can be tailored to bind with higher or lower affinity depending on the desired target; for example, an IL-2* can be engineered to bind with enhanced affinity to one of the receptor subunits and not the others. These types of partial agonists, unlike full agonists or complete antagonists, offer the ability to tune the signaling properties to an amplitude that elicits desired functional properties while not meeting thresholds for undesired properties. Given the differential activities of the partial agonists, a repertoire of IL-2 variants could be engineered to exhibit an even finer degree of distinctive signaling activities, ranging from almost full to partial agonism to complete antagonism.

In some embodiments, the IL-2* has altered affinity for IL-2Rα. In some embodiments, the IL-2* has a higher affinity for IL-2Rα than wild-type IL-2. In other embodiments, the IL-2* has altered affinity for IL-2Rβ. In one embodiment, IL-2* has enhanced binding affinity for IL-2Rβ, e.g., the N-terminus of IL-2Rβ, that eliminates the functional requirement for IL-2Rα. In another embodiment, an IL-2* is generated that has increased binding affinity for IL-2Rβ but that exhibited decreased binding to IL-2Rγ, and thereby is defective IL-2Rβγ heterodimerization and signaling.

Blocking moieties, described in further detail below, can also be used to favor binding to or activation of one or more receptors. In one embodiment, blocking moieties are added such that IL-2Rβγ binding or activation is blocked but IL-2Rα binding or activation is not changed. In another embodiment, blocking moieties are added such that IL-2Rα binding or activation is diminished. In another embodiment, blocking moieties are added such that binding to and or activation of all three receptors is inhibited. This blocking may be relievable by removal of the blocking moieties in a particular environment, for example by proteolytic cleavage of a linker linking one or more blocking moieties to the cytokine.

A similar approach can be applied to improve other cytokines, particularly for use as immunostimulatory agents, for example for treating cancer. For example, in this aspect, the pharmacokinetics and/or pharmacodynamics of the cytokine (e.g., IL-2, IL-7, IL-12, IL-15, IL-18, IL-21 IL-23, IFNα, IFNβ and IFNγ, TNFα, lymphotoxin, TGF-β1, TGFβ2, TGFβ3, GM-CSF, CXCL10, CCL19, CCL20, and CCL21 can be tailored to maximally activate effector cells (e.g., effect T cells, NK cells) and/or cytotoxic immune response promoting cells (e.g., induce dendritic cell maturation) at a site of desired activity, such as in a tumor, but preferably not systemically.

Thus, provided herein are pharmaceutical compositions comprising at least one cytokine polypeptide, such as interleukins (e.g., IL-2, IL-7, IL-12, IL-15, IL-18, IL-21, IL-23), interferons (IFNs, including IFNα, IFNβ and IFNγ), tumor necrosis factors (e.g., TNFα, lymphotoxin), transforming growth factors (e.g., TGF-β1, TGFβ2, TGFβ3), chemokines (e.g. CXCL10, CCL19, CCL20, CCL21) and granulocyte macrophage-colony stimulating factor (GM-CS) or a functional fragment or mutein of any of the foregoing. The polypeptide typically also includes at least one linker amino acid sequence, wherein the amino acid sequence is in certain embodiments capable of being cleaved by an endogenous protease. In one embodiment, the linker comprises an amino acid sequence comprising HSSKLQ (SEQ ID NO: 25), GPLGVRG (SEQ ID NO: 221), IPVSLRSG (SEQ ID NO: 222), VPLSLYSG (SEQ ID NO: 223), or SGESPAYYTA (SEQ ID NO: 224). In other embodiments, the chimeric polypeptide further contains a blocking moiety, e.g. a steric blocking polypeptide moiety, capable of blocking the activity of the interleukin polypeptide. The blocking moiety, for example, can comprise a human serum albumin (HSA) binding domain or an optionally branched or multi-armed polyethylene glycol (PEG). Alternatively, the pharmaceutical composition comprises a first cytokine polypeptide or a fragment thereof, and blocking moiety, e.g. a steric blocking polypeptide moiety, wherein the blocking moiety blocks the activity of the cytokine polypeptide on the cytokine receptor, and wherein the blocking moiety in certain embodiments comprises a protease cleavable domain. In some embodiments, blockade and reduction of cytokine activity is achieved simply by attaching additional domains with very short linkers to the N or C terminus of the interleukin domain. In such embodiments, it is anticipated the blockade is relieved by protease digestion of the blocking moiety or of the short linker that tethers the blocker to the interleukin. Once the domain is clipped or is released, it will no longer be able to achieve blockade of cytokine activity.

The pharmaceutical composition e.g., chimeric polypeptide can comprise two or more cytokines, which can be the same cytokine polypeptide or different cytokine polypeptides. For example, the two or more different types of cytokines have complementary functions. In some examples, a first cytokine is IL-2 and a second cytokine is IL-12. In some embodiments, each of the two or more different types of cytokine polypeptides have activities that modulate the activity of the other cytokine polypeptides. In some examples of chimeric polypeptides that contain two cytokine polypeptides, a first cytokine polypeptide is T-cell activating, and a second cytokine polypeptide is non-T-cell-activating. In some examples of chimeric polypeptides that contain two cytokine polypeptides, a first cytokine is a chemoattractant, e.g., CXCL10, and a second cytokine is an immune cell activator.

Preferably, the cytokine polypeptides (including functional fragments) that are included in the fusion proteins disclosed herein are not mutated or engineered to alter the properties of the naturally occurring cytokine, including receptor binding affinity and specificity or serum half-life. However, changes in amino acid sequence from naturally occurring (including wild type) cytokine are acceptable to facilitate cloning and to achieve desired expression levels, for example a. Blocking Moiety The blocking moiety can be any moiety that inhibits the ability of the cytokine to bind and/or activate its receptor. The blocking moiety can inhibit the ability of the cytokine to bind and/or activate its receptor sterically blocking and/or by noncovalently binding to the cytokine. Examples of suitable blocking moieties include the full length or a cytokine-binding fragment or mutein of the cognate receptor of the cytokine. Antibodies and fragments thereof including, a polyclonal antibody, a recombinant antibody, a human antibody, a humanized antibody a single chain variable fragment (scFv), single-domain antibody such as a heavy chain variable domain (VH), a light chain variable domain (VL) and a variable domain of camelid-type nanobody (VHH), a sdAb and the like that bind the cytokine can also be used. Other suitable antigen-binding domain that bind the cytokine can also be used, include non-immunoglobulin proteins that mimic antibody binding and/or structure such as, anticalins, affilins, affibody molecules, affimers, affitins, alphabodies, avimers, DARPins, fynomers, kunitz domain peptides, monobodies, and binding domains based on other engineered scaffolds such as SpA, GroEL, fibronectin, lipocalin and CTLA4 scaffolds. Further examples of suitable blocking polypeptides include polypeptides that sterically inhibit or block binding of the cytokine to its cognate receptor. Advantageously, such moieties can also function as half-life extending elements. For example, a peptide that is modified by conjugation to a water-soluble polymer, such as PEG, can sterically inhibit or prevent binding of the cytokine to its receptor. Polypeptides, or fragments thereof, that have long serum half-lives can also be used, such as serum albumin (human serum albumin), immunoglobulin Fc, transferring and the like, as well as fragments and muteins of such polypeptides.

Antibodies and antigen-binding domains that bind to, for example, a protein with a long serum half-life such as HSA, immunoglobulin or transferrin, or to a receptor that is recycled to the plasma membrane, such as FcRn or transferrin receptor, can also inhibit the cytokine, particularly when bound to their antigen. Examples of such antigen-binding polypeptides include a single chain variable fragment (scFv), single-domain antibody such as a heavy chain variable domain (VH), a light chain variable domain (VL) and a variable domain of camelid-type nanobody (VHH), a sdAb and the like. Other suitable antigen-binding domain that bind the cytokine can also be used, include non-immunoglobulin proteins that mimic antibody binding and/or structure such as, anticalins, affilins, affibody molecules, affimers, affitins, alphabodies, avimers, DARPins, fynomers, kunitz domain peptides, monobodies, and binding domains based on other engineered scaffolds such as SpA, GroEL, fibronectin, lipocalin and CTLA4 scaffolds.

In illustrative examples, when IL-2 is the cytokine in the chimeric polypeptide, the blocking moiety can be the full length or fragment or mutein of the alpha chain of IL-2 receptor (IL-2Rα) or beta (IL-2R13) or gamma chain of IL-2 receptor (IL-2Rγ), an anti-IL-2 single-domain antibody (sdAb) or scFv, an anti-CD25 antibody or fragment thereof, and anti-HSA sdAb or scFv, and the like.

b. In Vivo Half-Life Extension Elements

Preferably, the chimeric polypeptides comprise an in vivo half-life extension element. Increasing the in vivo half-life of therapeutic molecules with naturally short half-lives allows for a more acceptable and manageable dosing regimen without sacrificing effectiveness. As used herein, a "half-life extension element" is a part of the chimeric polypeptide that increases the in vivo half-life and improve pK, for example, by altering its size (e.g., to be above the kidney filtration cutoff), shape, hydrodynamic radius, charge, or parameters of absorption, biodistribution, metabolism, and elimination. An exemplary way to improve the pK of a polypeptide is by expression of an element in the polypeptide chain that binds to receptors that are recycled to the plasma membrane of cells rather than degraded in the lysosomes, such as the FcRn receptor on endothelial cells and transferrin receptor. Three types of proteins, e.g., human IgGs, HSA (or fragments), and transferrin, persist for much longer in human serum than would be predicted just by their size, which is a function of their ability to bind to receptors that are recycled rather than degraded in the lysosome. These proteins, or fragments of them that retain the FcRn binding are routinely linked to other polypeptides to extend their serum half-life. In one embodiment, the half-life extension element is a human serum albumin (HSA) binding domain. HSA (SEQ ID NO:2) may also be directly bound to the pharmaceutical compositions or bound via a short linker. Fragments of HSA may also be used. HSA and fragments thereof can function as both a blocking moiety and a half-life extension element. Human IgGs can also carry out a similar function.

The serum half-life extension element can also be antigen-binding polypeptide that binds to a protein with a long serum half-life such as serum albumin, transferrin and the like. Examples of such polypeptides include antibodies and fragments thereof including, a polyclonal antibody, a recombinant antibody, a human antibody, a humanized antibody a single chain variable fragment (scFv), single-domain antibody such as a heavy chain variable domain (VH), a light chain variable domain (VL) and a variable domain of camelid-type nanobody (VHH), a sdAb and the like. Other suitable antigen-binding domain include non-immunoglobulin proteins that mimic antibody binding and/or structure such as, anticalins, affilins, affibody molecules, affimers, affitins, alphabodies, avimers, DARPins, fynomers, kunitz domain peptides, monobodies, and binding domains based on other engineered scaffolds such as SpA, GroEL, fibronectin, lipocalin and CTLA4 scaffolds. Further examples of antigen-binding polypeptides include a ligand for a desired receptor, a ligand-binding portion of a receptor, a lectin, and peptides that binds to or associates with one or more target antigens.

Some preferred serum half-life extension elements are polypeptides that comprise complementarity determining regions (CDRs), and optionally non-CDR loops. Advantageously, such serum half-life extension elements can extend the serum half-life of the cytokine, and also function as inhibitors of the cytokine (e.g., via steric blocking, non-covalent interaction or combination thereof) and/or as targeting domains. In some instances, the serum half-life extension elements are domains derived from an immunoglobulin molecule (Ig molecule) or engineered protein scaffolds that mimic antibody structure and/or binding activity.

The Ig may be of any class or subclass (IgG1, IgG2, IgG3, IgG4, IgA, IgE, IgM etc.). A polypeptide chain of an Ig molecule folds into a series of parallel beta strands linked by loops. In the variable region, three of the loops constitute the "complementarity determining regions" (CDRs) which determine the antigen binding specificity of the molecule. An IgG molecule comprises at least two heavy (H) chains and two light (L) chains inter-connected by disulfide bonds, or an antigen binding fragment thereof. Each heavy chain is comprised of a heavy chain variable region (abbreviated herein as VH) and a heavy chain constant region. The heavy chain constant region is comprised of three domains, CH1, CH2 and CH3. Each light chain is comprised of a light chain variable region (abbreviated herein as VL) and a light chain constant region. The light chain constant region is comprised of one domain, CL. The VH and VL regions can be further subdivided into regions of hypervariability, termed complementarity determining regions (CDRs) with are hypervariable in sequence and/or involved in antigen recognition and/or usually form structurally defined loops, interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. In some embodiments of this disclosure, at least some or all of the amino acid sequences of FR1, FR2, FR3, and FR4 are part of the "non-CDR loop" of the binding moieties described herein. A variable domain of an immunoglobulin molecule has several beta strands that are arranged in two sheets. The variable domains of both light and heavy immunoglobulin chains contain three hypervariable loops, or complementarity-determining regions (CDRs). The three CDRs of a V domain (CDR1, CDR2, CDR3) cluster at one end of the beta barrel. The CDRs are the loops that connect beta strands B-C, C-C", and F-G of the immunoglobulin fold, whereas the bottom loops that connect beta strands AB, CC', C"-D and E-F of the immunoglobulin fold, and the top loop that connects the D-E strands of the immunoglobulin fold are the non-CDR loops. In some embodiments of this disclosure, at least some amino acid residues of a constant domain, CH1, CH2, or CH3, are part of the "non-CDR loop" of the binding moieties described herein. Non-CDR loops comprise, in some embodiments, one or more of AB, CD, EF, and DE loops of a C1-set domain of an Ig or an Ig-like molecule; AB, CC', EF, FG, BC, and EC' loops of a C2-set domain of an Ig or an Ig-like molecule; DE, BD, GF, A(A1A2)B, and EF loops of I(Intermediate)-set domain of an Ig or Ig-like molecule.

Within the variable domain, the CDRs are believed to be responsible for antigen recognition and binding, while the FR residues are considered a scaffold for the CDRs. However, in certain cases, some of the FR residues play an important role in antigen recognition and binding. Framework region residues that affect Ag binding are divided into two categories. The first are FR residues that contact the antigen, thus are part of the binding-site, and some of these residues are close in sequence to the CDRs. Other residues are those that are far from the CDRs in sequence but are in close proximity to it in the 3-D structure of the molecule, e.g., a loop in heavy chain The binding moieties are any kinds of polypeptides. For example, in certain instances the binding moieties are natural peptides, synthetic peptides, or fibronectin scaffolds, or engineered bulk serum proteins. The bulk serum protein comprises, for example, albumin, fibrinogen, or a globulin. In some embodiments, the binding moieties are engineered scaffolds. Engineered scaffolds comprise, for example, a sdAb, a scFv, a Fab, a VHH, a fibronectin type III domain, immunoglobulin-like scaffold (as suggested in Halaby et al., 1999. Prot Eng 12(7):563-571), DARPin, cystine knot peptide, lipocalin, three-helix bundle scaffold, protein G-related albumin-binding module, or a DNA or RNA aptamer scaffold.

In some cases, the serum half-life extending element comprises a binding site for a bulk serum protein. In some embodiments, the CDRs provide the binding site for the bulk serum protein. The bulk serum protein is, in some examples, a globulin, albumin, transferrin, IgG1, IgG2, IgG4, IgG3, IgA monomer, Factor XIII, Fibrinogen, IgE, or pentameric IgM. In some embodiments, the CDR form a binding site for an immunoglobulin light chain, such as an Igκ free light chain or an Igλ, free light chain The serum half-life extension element can be any type of binding domain, including but not limited to, domains from a monoclonal antibody, a polyclonal antibody, a recombinant antibody, a human antibody, a humanized antibody. In some embodiments, the binding moiety is a single chain variable fragment (scFv), single-domain antibody such as a heavy chain variable domain (VH), a light chain variable domain (VL) and a variable domain (VHH) of camelid derived nanobody. In other embodiments, the binding moieties are non-Ig binding domains, i.e., antibody mimetic, such as anticalins, affilins, affibody molecules, affimers, affitins, alphabodies, avimers, DARPins, fynomers, kunitz domain peptides, and monobodies.

In other embodiments, the serum half-life extension element can be a water-soluble polymer or a peptide that is conjugated to a water-soluble polymer, such as PEG. "PEG," "polyethylene glycol" and "poly(ethylene glycol)" as used herein, are interchangeable and encompass any nonpeptidic water-soluble poly(ethylene oxide). The term "PEG" also means a polymer that contains a majority, that is to say, greater than 50%, of —OCH$_2$CH$_2$—repeating subunits. With respect to specific forms, the PEG can take any number of a variety of molecular weights, as well as structures or geometries such as "branched," "linear," "forked," "multifunctional," and the like, to be described in greater detail below. The PEG is not limited to a particular structure and can be linear (e.g., an end capped, e.g., alkoxy PEG or a bifunctional PEG), branched or multi-armed (e.g., forked PEG or PEG attached to a polyol core), a dendritic (or star) architecture, each with or without one or more degradable linkages. Moreover, the internal structure of the PEG can be organized in any number of different repeat patterns and can be selected from the group consisting of homopolymer, alternating copolymer, random copolymer, block copolymer, alternating tripolymer, random tripolymer, and block tripolymer. PEGs can be conjugated to polypeptide and peptides through any suitable method. Typically a reactive PEG derivative, such as N-hydroxysuccinamidyl ester PEG, is reacted with a peptide or polypeptide that includes amino acids with a side chain that contains an amine, sulfhydryl, carboxylic acid or hydroxyl functional group, such as cysteine, lysine, asparagine, glutamine, threonine, tyrosine, serine, aspartic acid, and glutamic acid.

c. Targeting and Retention Domains

For certain applications, it may be desirable to maximize the amount of time the construct is present in its desired location in the body. This can be achieved by including one further domain in the chimeric polypeptide (fusion protein) to influence its movements within the body. For example, the chimeric nucleic acids can encode a domain that directs the polypeptide to a location in the body, e.g., tumor cells or a site of inflammation; this domain is termed a "targeting domain" and/or encode a domain that retains the polypeptide in a location in the body, e.g., tumor cells or a site of inflammation; this domain is termed a "retention domain" In some embodiments a domain can function as both a targeting and a retention domain. In some embodiments, the targeting domain and/or retention domain are specific to a protease-rich environment. In some embodiments, the encoded targeting domain and/or retention domain are specific for regulatory T cells (Tregs), for example targeting the CCR4 or CD39 receptors. Other suitable targeting and/or retention domains comprise those that have a cognate ligand that is overexpressed in inflamed tissues, e.g., the IL-1 receptor, or the IL-6 receptor. In other embodiments, the suitable targeting and/or retention domains comprise those who have a cognate ligand that is overexpressed in tumor tissue, e.g., Epcam, CEA or mesothelin. In some embodiments, the targeting domain is linked to the interleukin via a linker which is cleaved at the site of action (e.g. by inflammation or cancer specific proteases) releasing the interleukin full activity at the desired site. In some embodiments, the targeting and/or retention domain is linked to the interleukin via a linker which is not cleaved at the site of action (e.g. by inflammation or cancer specific proteases), causing the cytokine to remain at the desired site.

Antigens of choice, in some cases, are expressed on the surface of a diseased cell or tissue, for example a tumor or a cancer cell. Antigens useful for tumor targeting and retention include but are not limited to EpCAM, EGFR, HER-2, HER-3, c-Met, FoIR, and CEA. Pharmaceutical compositions disclosed herein, also include proteins comprising two targeting and/or retention domains that bind to two different target antigens known to be expressed on a diseased cell or tissue. Exemplary pairs of antigen binding domains include but are not limited to EGFR/CEA, EpCAM/CEA, and HER-2/HER-3.

Suitable targeting and/or retention domains include antigen-binding domains, such as antibodies and fragments thereof including, a polyclonal antibody, a recombinant antibody, a human antibody, a humanized antibody a single chain variable fragment (scFv), single-domain antibody such as a heavy chain variable domain (VH), a light chain variable domain (VL) and a variable domain of camelid-type nanobody (VHH), a sdAb and the like. Other suitable antigen-binding domain include non-immunoglobulin proteins that mimic antibody binding and/or structure such as, anticalins, affilins, affibody molecules, affimers, affitins, alphabodies, avimers, DARPins, fynomers, kunitz domain peptides, monobodies, and binding domains based on other engineered scaffolds such as SpA, GroEL, fibronectin, lipocalin and CTLA4 scaffolds. Further examples of antigen-binding polypeptides include a ligand for a desired receptor, a ligand-binding portion of a receptor, a lectin, and peptides that binds to or associates with one or more target antigens.

In some embodiments, the targeting and/or retention domains specifically bind to a cell surface molecule. In some embodiments, the targeting and/or retention domains specifically bind to a tumor antigen. In some embodiments, the targeting polypeptides specifically and independently bind to a tumor antigen selected from at least one of EpCAM, EGFR, HER-2, HER-3, cMet, CEA, and FoIR. In some embodiments, the targeting polypeptides specifically and independently bind to two different antigens, wherein at least one of the antigens is a tumor antigen selected from EpCAM, EGFR, HER-2, HER-3, cMet, CEA, and FoIR.

The targeting and/or retention antigen can be a tumor antigen expressed on a tumor cell. Tumor antigens are well known in the art and include, for example, EpCAM, EGFR, HER-2, HER-3, c-Met, Fo1R, PSMA, CD38, BCMA, and CEA. 5T4, AFP, B7-H3, Cadherin-6, CAIX, CD117, CD123, CD138, CD166, CD19, CD20, CD205, CD22, CD30, CD33, CD352, CD37, CD44, CD52, CD56, CD70, CD71, CD74, CD79b, DLL3, EphA2, FAP, FGFR2, FGFR3, GPC3, gpA33, FLT-3, gpNMB, HPV-16 E6, HPV-16 E7, ITGA2, ITGA3, SLC39A6, MAGE, mesothelin, Muc1, Muc16, *NaPi*2b, Nectin-4, P-cadherin, NY-ESO-1, PRLR, PSCA, PTK7, ROR1, SLC44A4, SLTRK5, SLTRK6, STEAP1, TIM1, Trop2, WT1.

The targeting and/or retention antigen can be an immune checkpoint protein. Examples of immune checkpoint proteins include but are not limited to CD27, CD137, 2B4, TIGIT, CD155, ICOS, HVEM, CD40L, LIGHT, TIM-1, OX40, DNAM-1, PD-L1, PD1, PD-L2, CTLA-4, CD8, CD40, CEACAMI, CD48, CD70, A2AR, CD39, CD73, B7-H3, B7-H4, BTLA, IDO1, IDO2, TDO, KIR, LAG-3, TIM-3, or VISTA.

The targeting and/or retention antigen can be a cell surface molecule such as a protein, lipid or polysaccharide. In some embodiments, a targeting and/or retention antigen is a on a tumor cell, virally infected cell, bacterially infected cell, damaged red blood cell, arterial plaque cell, inflamed or fibrotic tissue cell. The targeting and/or retention antigen can comprise an immune response modulator. Examples of immune response modulator include but are not limited to granulocyte-macrophage colony stimulating factor (GM-CSF), macrophage colony stimulating factor (M-CSF), granulocyte colony stimulating factor (G-CSF), interleukin 2 (IL-2), interleukin 3 (IL-3), interleukin 12 (IL-12), interleukin 15 (IL-15), B7-1 (CD80), B7-2 (CD86), GITRL, CD3, or GITR.

The targeting and/or retention antigen can be a cytokine receptor. Examples, of cytokine receptors include but are not limited to Type I cytokine receptors, such as GM-CSF receptor, G-CSF receptor, Type I IL receptors, Epo receptor, LIF receptor, CNTF receptor, TPO receptor; Type II Cytokine receptors, such as IFN-alpha receptor (IFNAR1, IFNAR2), IFB-beta receptor, IFN-gamma receptor (IFNGR1, IFNGR2), Type II IL receptors; chemokine receptors, such as CC chemokine receptors, CXC chemokine receptors, CX3C chemokine receptors, XC chemokine receptors; tumor necrosis receptor superfamily receptors, such as TNFRSF5/CD40, TNFRSF8/CD30, TNFRSF7/CD27, TNFRSF1A/TNFR1/CD120a, TNFRSF1B/TNFR2/CD120b; TGF-beta receptors, such as TGF-beta receptor 1, TGF-beta receptor 2; Ig super family receptors, such as IL-1 receptors, CSF-1R, PDGFR (PDGFRA, PDGFRB), SCFR.

d. Linkers

As stated above, the pharmaceutical compositions comprise one or more linker sequences. A linker sequence serves to provide flexibility between polypeptides, such that, for example, the blocking moiety is capable of inhibiting the activity of the cytokine polypeptide. The linker sequence can be located between any or all of the cytokine polypeptide, the serum half-life extension element, and/or the blocking moiety. As described herein, at least one of the linkers is protease cleavable, and contains a (one or more) cleavage site for a (one or more) desired protease. Preferably, the desired protease is enriched or selectively expressed at the desired site of cytokine activity (e.g., the tumor microenvironment). Thus, the fusion protein is preferentially or selectively cleaved at the site of desired cytokine activity.

The orientation of the components of the pharmaceutical composition, are largely a matter of design choice and it is recognized that multiple orientations are possible, and all are intended to be encompassed by this disclosure. For example, a blocking moiety can be located C-terminally or N-terminally to a cytokine polypeptide.

Provided herein are pharmaceutical compositions comprising polypeptide sequences. As with all peptides, polypeptides, and proteins, including fragments thereof, it is understood that additional modifications in the amino acid sequence of the chimeric polypeptides (amino acid sequence variants) can occur that do not alter the nature or function of the peptides, polypeptides, or proteins. Such modifications include conservative amino acid substitutions and are discussed in greater detail below.

The compositions provided herein have a desired function. The compositions are comprised of at least a cytokine polypeptide, such as IL-2, IL-7, IL-12, IL-15, IL-18, IL-21, or IFNγ, or a chemokine, such as CXCL10, CCL19, CCL20, CCL21, a blocking moiety, e.g. a steric blocking polypeptide, and an optional serum half-life extension element, and an optional targeting polypeptide, with one or more linkers connecting each polypeptide in the composition. The first polypeptide, e.g., an IL-2 mutein, is provided to be an active agent. The blocking moiety is provided to block the activity of the interleukin. The linker polypeptide, e.g., a protease cleavable polypeptide, is provided to be cleaved by a protease that is specifically expressed at the intended target of the active agent. Optionally, the blocking moiety blocks the activity of the first polypeptide by binding the interleukin polypeptide. In some embodiments, the blocking moiety, e.g. a steric blocking peptide, is linked to the interleukin via a protease-cleavable linker which is cleaved at the site of action (e.g. by inflammation specific proteases) releasing the cytokine full activity at the desired site.

In some embodiments, the linker comprises glycine-glycine, a sortase-recognition motif, or a sortase-recognition motif and a peptide sequence $(Gly_4Ser)_n$ (SEQ ID NO: 238) or $(Gly_3Ser)_n$ (SEQ ID NO: 239), wherein n is 1, 2, 3, 4 or 5. In one embodiment, the sortase-recognition motif comprises a peptide sequence LPXTG, where X is any amino acid (SEQ ID NO: 237). In one embodiment, the covalent linkage is between a reactive lysine residue attached to the C-terminal of the cytokine polypeptide and a reactive aspartic acid attached to the N-terminal of the blocking or other moiety. In one embodiment, the covalent linkage is between a reactive aspartic acid residue attached to the N-terminal of the cytokine polypeptide and a reactive lysine residue attached to the C-terminal of the blocking or other moiety.

e. Cleavage and Inducibility

As described herein, the activity of the cytokine polypeptide the context of the fusion protein is attenuated, and protease cleavage at the desired site of activity, such as in a tumor microenvironment, releases a form of the cytokine from the fusion protein that is much more active as a cytokine receptor agonist than the fusion protein. For example, the cytokine-receptor activating (agonist) activity of the fusion polypeptide can be at least about 10×, at least about 50×, at least about 100×, at least about 250×, at least about 500×, or at least about 1000× less than the cytokine receptor activating activity of the cytokine polypeptide as a separate molecular entity. The cytokine polypeptide that is part of the fusion protein exists as a separate molecular entity when it contains an amino acid that is substantially identical to the cytokine polypeptide and does not substantially include additional amino acids and is not associated (by covalent or non-covalent bonds) with other molecules. If necessary, a cytokine polypeptide as a separate molecular entity may include some additional amino acid sequences, such as a tag or short sequence to aid in expression and/or purification.

In other examples, the cytokine-receptor activating (agonist) activity of the fusion polypeptide is at least about 10×, at least about 50×, at least about 100×, at least about 250×, at least about 500×, or about 1000× less than the cytokine receptor activating activity of the polypeptide that contains the cytokine polypeptide that is produced by cleavage of the protease cleavable linker in the fusion protein. In other words, the cytokine receptor activating (agonist) activity of the polypeptide that contains the cytokine polypeptide that is produced by cleavage of the protease cleavable linker in the fusion protein is at least about 10×, at least about 50×, at least about 100×, at least about 250×, at least about 500×, or at least about 1000× greater than the cytokine receptor activating activity of the fusion protein. In other examples, a recombinant polypeptide is in conjugation with a cleavable moiety wherein the cleavable moiety is cleaved with reduced catalytic efficiency by one or more proteases than a reference polypeptide sequence.

In some embodiments, the cleavable moiety is resistant to proteolytic cleavage by one or more proteases. A cleavable moiety is resistant to a protease if the sequence comprises a binding site that is altered from the canonical cleavable motif sequence for the specific protease. In some embodiments, a binding site is altered compared to a reference sequence by making one or more substitutions in the protease cleavage motif sequence. For example, the protease cathepsin S cleaves the sequence GAVVRGA (SEQ ID NO: 240); a sequence is made to substitution can be made to substitute the arginine (R) with a glutamine (Q), thus changing a charged residue to a shorter, polar residue, reducing the ability of cathepsin S to bind and cleave the sequence. Such semi-conservative amino acid substitutions in protease target sequence motifs can lead to reduced binding ability, and such altered sequence motifs are therefore protease resistant. An uncleavable moiety can be made by inserting a disruptive amino acid into the protease target sequence motif, such as a proline (causes curves in the secondary structure of the peptide) or histidine (causes steric interference with other amino acid side chains). As used herein, a "protease-resistant" peptide linker is one with reduced or undetectable cleavage by one or more specified proteases. Exemplary protease-resistant peptide linkers can be tested, e.g., in vitro by incubation with a specific protease followed by analysis of the digestion products by western blot.

f. Polypeptide Substitutions

The polypeptides described herein can include components (e.g., the cytokine, the blocking moiety) that have the same amino acid sequence of the corresponding naturally occurring protein (e.g., IL-2, IL-15, HSA) or can have an amino acid sequence that differs from the naturally occurring protein so long as the desired function is maintained. It is understood that one way to define any known modifications and derivatives or those that might arise, of the disclosed proteins and nucleic acids that encode them is through defining the sequence variants in terms of identity to specific known reference sequences. Specifically disclosed are polypeptides and nucleic acids which have at least, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 percent identity to the chimeric polypeptides provided herein. For example, provided are polypeptides or nucleic acids that have at least, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 percent identity to the sequence of any of the nucleic acids or polypeptides described herein. This includes polypeptides or nucleic acids that have at least, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 percent identity to the sequence of the cleavable linkers provided herein. This also includes variants of the linker or inducible polypeptides that comprise 1, 2, 3, 4, 5, or 6 variants from the cleavage domain sequences. Those of skill in the art readily understand how to determine the identity of two polypeptides or two nucleic acids. For example, the identity can be calculated after aligning the two sequences so that the identity is at its highest level.

Another way of calculating identity can be performed by published algorithms. Optimal alignment of sequences for comparison may be conducted by the local identity algorithm of Smith and Waterman Adv. Appl. Math. 2:482 (1981), by the identity alignment algorithm of Needleman and Wunsch, J. Mol. Biol. 48:443 (1970), by the search for similarity method of Pearson and Lipman, Proc. Natl. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by inspection.

The same types of identity can be obtained for nucleic acids by, for example, the algorithms disclosed in Zuker, Science 244:48-52 (1989); Jaeger et al., Proc. Natl. Acad. Sci. USA 86:7706-7710 (1989); Jaeger et al., Methods Enzymol. 183:281-306 (1989), which are herein incorporated by reference for at least material related to nucleic acid alignment. It is understood that any of the methods typically can be used and that in certain instances the results of these various methods may differ, but the skilled artisan understands if identity is found with at least one of these methods, the sequences would be said to have the stated identity, and be disclosed herein.

Protein modifications include amino acid sequence modifications. Modifications in amino acid sequence may arise naturally as allelic variations (e.g., due to genetic polymorphism), may arise due to environmental influence (e.g., by exposure to ultraviolet light), or may be produced by human intervention (e.g., by mutagenesis of cloned DNA sequences), such as induced point, deletion, insertion and substitution mutants. These modifications can result in changes in the amino acid sequence, provide silent mutations, modify a restriction site, or provide other specific mutations. Amino acid sequence modifications typically fall into one or more of three classes: substitutional, insertional or deletional modifications. Insertions include amino and/or carboxyl terminal fusions as well as intrasequence insertions of single or multiple amino acid residues. Insertions ordinarily will be smaller insertions than those of amino or carboxyl terminal fusions, for example, on the order of one to four residues. Deletions are characterized by the removal of one or more amino acid residues from the protein sequence. Typically, no more than about from 2 to 6 residues are deleted at any one site within the protein molecule Amino acid substitutions are typically of single residues but can occur at a number of different locations at once; insertions usually will be on the order of about from 1 to 10 amino acid residues; and deletions will range about from 1 to 30 residues. Deletions or insertions preferably are made in adjacent pairs, i.e. a deletion of 2 residues or insertion of 2 residues. Substitutions, deletions, insertions or any combination thereof may be combined to arrive at a final construct. The mutations must not place the sequence out of reading frame and preferably will not create complementary regions that could produce secondary mRNA structure. Substitutional modifications are those in which at least one residue has been removed and a different residue inserted in its place. Such substitutions generally are made in accordance with the following Table 2 and are referred to as conservative substitutions.

TABLE 2

Exemplary amino acid substitutions

| Amino Acid | Exemplary Substitutions |
|---|---|
| Ala | Ser, Gly, Cys |
| Arg | Lys, Gln, Met, Ile |
| Asn | Gln, His, Glu, Asp |
| Asp | Glu, Asn, Gln |
| Cys | Ser, Met, Thr |
| Gln | Asn, Lys, Glu, Asp |
| Glu | Asp, Asn, Gln |
| Gly | Pro, Ala |
| His | Asn, Gln |
| Ile | Leu, Val, Met |
| Leu | Ile, Val, Met |
| Lys | Arg, Gln, Met, Ile |
| Met | Leu, Ile, Val |
| Phe | Met, Leu, Tyr, Trp, His |
| Ser | Thr, Met, Cys |
| Thr | Ser, Met, Val |
| Trp | Tyr, Phe |
| Tyr | Trp, Phe, His |
| Val | Ile, Leu, Met |

Modifications, including the specific amino acid substitutions, are made by known methods. For example, modifications are made by site specific mutagenesis of nucleotides in the DNA encoding the polypeptide, thereby producing DNA encoding the modification, and thereafter expressing the DNA in recombinant cell culture. Techniques for making substitution mutations at predetermined sites in DNA having a known sequence are well known, for example M13 primer mutagenesis and PCR mutagenesis.

Modifications can be selected to optimize binding. For example, affinity maturation techniques can be used to alter binding of the scFv by introducing random mutations inside the complementarity determining regions (CDRs). Such random mutations can be introduced using a variety of techniques, including radiation, chemical mutagens or error-prone PCR. Multiple rounds of mutation and selection can be performed using, for example, phage display.

The disclosure also relates to nucleic acids that encode the chimeric polypeptides described herein, and to the use of such nucleic acids to produce the chimeric polypeptides and for therapeutic purposes. For example, the invention includes DNA and RNA molecules (e.g., mRNA, self-replicating RNA) that encode a chimeric polypeptide and to the therapeutic use of such DNA and RNA molecules.

g. Exemplary Compositions

Exemplary fusion proteins of the invention combine the above described elements in a variety of orientations. The orientations described in this section are meant as examples and are not to be considered limiting.

In some embodiments, the fusion protein comprises a cytokine, a blocking moiety and a half-life extension element. In some embodiments, the cytokine is positioned between the half-life extension element and the blocking moiety. In some embodiments, the cytokine is N-terminal to the blocking moiety and the half-life extension element. In some such embodiments, the cytokine is proximal to the blocking moiety; in some such embodiments, the cytokine is proximal to the half-life extension element. At least one protease-cleavable linker must be included in all embodiments, such that the cytokine may be active upon cleavage. In some embodiments, the cytokine is C-terminal to the blocking moiety and the half-life extension element. Additional elements may be attached to one another by a cleavable linker, a non-cleavable linker, or by direct fusion.

In some embodiments, the blocking domains used are capable of extending half-life, and the cytokine is positioned between two such blocking domains. In some embodiments, the cytokine is positioned between two blocking domains, one of which is capable of extending half-life.

In some embodiments, two cytokines are included in the same construct. In some embodiments, the cytokines are connected to two blocking domains each (three in total in one molecule), with a blocking domain between the two cytokine domains. In some embodiments, one or more additional half-life extension domains may be included to optimize pharmacokinetic properties.

In some embodiments, three cytokines are included in the same construct. In some embodiments, the third cytokine may function to block the other two in place of a blocking domain between the two cytokines.

Preferred half-life extension elements for use in the fusion proteins are human serum albumin (HSA), an antibody or antibody fragment (e.g., scFV, dAb) which binds serum albumin, a human or humanized IgG, or a fragment of any of the foregoing. In some preferred embodiments, the blocking moiety is human serum albumin (HSA), or an antibody or antibody fragment which binds serum albumin, an antibody which binds the cytokine and prevents activation of binding or activation of the cytokine receptor, another cytokine, or a fragment of any of the foregoing. In preferred embodiments comprising an additional targeting domain, the targeting domain is an antibody which binds a cell surface protein which is enriched on the surface of cancer cells, such as EpCAM, FOLR1, and Fibronectin.

vii. Other Uses

The separation moieties disclosed herein can be used for antibody-antibiotic conjugates. The separation moiety disclosed herein connects or links an antimicrobial antibiotic to an antibody specific for a bacterial strain (e.g., *Staphylococcus aureus* Ab). The antibody-antibiotic conjugate does not display antibacterial activity when the antibody is linked to the antibiotic. However, upon internalization into host cells, the separation moiety is cleaved by proteases releasing the free antibiotic. The free antibiotic kills the intracellular bacteria.

The separation moieties disclosed herein can be used for applications in chemical probes use for detection and isolation of proteins. Chemical probes are designed based on small molecule interaction with proteins. The probes typically comprise a covalent binding motif in order for the probe to interact with the target protein, a detection/purification tag for visualization/purification of the protein target and a linker group. The separation moieties described herein can be incorporated to enable the target protein to be detected and isolated.

C. Methods of Treatment and Pharmaceutical Compositions

Further provided are methods of treating a subject with or at risk of developing an of a disease or disorder, such as proliferative disease, a tumorous disease, an inflammatory disease, an immunological disorder, an autoimmune disease, an infectious disease, a viral disease, an allergic reaction, a parasitic reaction, or graft-versus-host disease. The methods administering to a subject in need thereof an effective amount of a fusion protein as disclosed herein that is typically administered as a pharmaceutical composition. In some embodiments, the method further comprises selecting a subject with or at risk of developing such a disease or disorder. The pharmaceutical composition preferably comprises a blocked cytokine, fragment or mutein thereof that is activated at a site of inflammation. In one embodiment, the chimeric polypeptide comprises a cytokine polypeptide, fragment or mutein thereof and a serum half-life extension element. In another embodiment, the chimeric polypeptide comprises a cytokine polypeptide, fragment or mutein thereof and a blocking moiety, e.g. a steric blocking polypeptide, wherein the steric blocking polypeptide is capable of sterically blocking the activity of the cytokine polypeptide, fragment or mutein thereof. In another embodiment, the chimeric polypeptide comprises a cytokine polypeptide, fragment or mutein thereof, a blocking moiety, and a serum half-life extension element.

Inflammation is part of the complex biological response of body tissues to harmful stimuli, such as pathogens, damaged cells, or irritants, and is a protective response involving immune cells, blood vessels, and molecular mediators. The function of inflammation is to eliminate the initial cause of cell injury, clear out necrotic cells and tissues damaged from the original insult and the inflammatory process, and to initiate tissue repair. Inflammation can occur from infection, as a symptom or a disease, e.g., cancer, atherosclerosis, allergies, myopathies, HIV, obesity, or an autoimmune disease. An autoimmune disease is a chronic condition arising from an abnormal immune response to a self-antigen. Autoimmune diseases that may be treated with the polypeptides disclosed herein include but are not limited to lupus, celiac disease, diabetes mellitus type 1, Graves' disease, inflammatory bowel disease, multiple sclerosis, psoriasis, rheumatoid arthritis, and systemic lupus erythematosus.

The pharmaceutical composition can comprise one or more protease-cleavable linker sequences. The linker sequence serves to provide flexibility between polypeptides, such that each polypeptide is capable of inhibiting the activity of the first polypeptide. The linker sequence can be located between any or all of the cytokine polypeptide, fragment or mutein thereof, the blocking moiety, and serum half-life extension element. Optionally, the composition comprises, two, three, four, or five linker sequences. The linker sequence, two, three, or four linker sequences can be the same or different linker sequences. In one embodiment, the linker sequence comprises GGGGS (SEQ ID NO: 232), GSGSGS (SEQ ID NO: 233), or G(SGGG)2SGGT (SEQ ID NO: 234). In another embodiment, the linker comprises a protease-cleavable sequence selected from group consisting of HSSKLQ (SEQ ID NO: 25), GPLGVRG (SEQ ID NO:221), IPVSLRSG (SEQ ID NO: 222), VPLSLYSG (SEQ ID NO: 223), or SGESPAYYTA (SEQ ID NO: 224). In some embodiments, the linker is cleaved by a protease selected from the group consisting of a kallikrein, thrombin, chymase, carboxypeptidase A, cathepsin G, an elastase, PR-3, granzyme M, a calpain, a matrix metalloproteinase (MMP), a plasminogen activator, a cathepsin, a caspase, a tryptase, or a tumor cell surface protease.

Further provided are methods of treating a subject with or at risk of developing cancer. The methods comprise administering to the subject in need thereof an effective amount of a chimeric polypeptide (a fusion protein) as disclosed herein that is typically administered as a pharmaceutical composition. In some embodiments, the method further comprises selecting a subject with or at risk of developing cancer. The pharmaceutical composition preferably comprises a blocked cytokine, fragment or mutein thereof that is activated at a tumor site. Preferably, the tumor is a solid tumor. The cancer may be a colon cancer, a lung cancer, a melanoma, a sarcoma, a renal cell carcinoma, a breast cancer, The method can further involve the administration of one or more additional agents to treat cancer, such as chemotherapeutic agents (e.g., Adriamycin, Cerubidine, Bleomycin, Alkeran, Velban, Oncovin, Fluorouracil, Thiotepa, Methotrexate, Bisantrene, Noantrone, Thiguanine, Cytaribine, Procarabizine), immuno-oncology agents (e.g., anti-PD-L1, anti-CTLA4, anti-PD-1, anti-CD47, anti-GD2), cellular therapies (e.g, CAR-T, T-cell therapy), oncolytic viruses and the like.

Provided herein are pharmaceutical formulations or compositions containing the chimeric polypeptides and a pharmaceutically acceptable carrier. The herein provided compositions are suitable for administration in vitro or in vivo. By pharmaceutically acceptable carrier is meant a material that is not biologically or otherwise undesirable, i.e., the material is administered to a subject without causing undesirable biological effects or interacting in a deleterious manner with the other components of the pharmaceutical formulation or composition in which it is contained. The carrier is selected to minimize degradation of the active ingredient and to minimize adverse side effects in the subject.

Suitable carriers and their formulations are described in *Remington: The Science and Practice of Pharmacy*, 21$^{st}$ Edition, David B. Troy, ed., Lippicott Williams & Wilkins (2005). Typically, an appropriate amount of a pharmaceutically acceptable salt is used in the formulation to render the formulation isotonic, although the formulate can be hypertonic or hypotonic if desired. Examples of the pharmaceutically acceptable carriers include, but are not limited to, sterile water, saline, buffered solutions like Ringer's solution, and dextrose solution. The pH of the solution is generally about 5 to about 8 or from about 7 to 7.5. Other carriers include sustained release preparations such as semipermeable matrices of solid hydrophobic polymers containing the immunogenic polypeptides. Matrices are in the form of shaped articles, e.g., films, liposomes, or microparticles. Certain carriers may be more preferable depending upon, for instance, the route of administration and concentration of composition being administered. Carriers are those suitable for administration of the chimeric polypeptides or nucleic acid sequences encoding the chimeric polypeptides to humans or other subjects.

The pharmaceutical formulations or compositions are administered in a number of ways depending on whether local or systemic treatment is desired and, on the area to be treated. The compositions are administered via any of several routes of administration, including topically, orally, parenterally, intravenously, intra-articularly, intraperitoneally, intramuscularly, subcutaneously, intracavity, transdermally, intrahepatically, intracranially, nebulization/inhalation, or by installation via bronchoscopy. In some embodiments, the compositions are administered locally (non-systemically), including intratumorally, intra-articularly, intrathecally, etc.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives are optionally present such as, for example, antimicrobials, antioxidants, chelating agents, and inert gases and the like.

Formulations for topical administration include ointments, lotions, creams, gels, drops, suppositories, sprays, liquids, and powders. Conventional pharmaceutical carriers, aqueous, powder, or oily bases, thickeners and the like are optionally necessary or desirable.

Compositions for oral administration include powders or granules, suspension or solutions in water or non-aqueous media, capsules, sachets, or tables. Thickeners, flavorings, diluents, emulsifiers, dispersing aids or binders are optionally desirable.

Optionally, the chimeric polypeptides or nucleic acid sequences encoding the chimeric polypeptides are administered by a vector. There are a number of compositions and methods which can be used to deliver the nucleic acid molecules and/or polypeptides to cells, either in vitro or in vivo via, for example, expression vectors. These methods and compositions can largely be broken down into two classes: viral based delivery systems and non-viral based delivery systems. Such methods are well known in the art and readily adaptable for use with the compositions and methods described herein. Such compositions and methods can be used to transfect or transduce cells in vitro or in vivo, for example, to produce cell lines that express and preferably secrete the encoded chimeric polypeptide or to therapeutically deliver nucleic acids to a subject. The components of the chimeric nucleic acids disclosed herein typically are operably linked in frame to encode a fusion protein.

As used herein, plasmid or viral vectors are agents that transport the disclosed nucleic acids into the cell without degradation and include a promoter yielding expression of the nucleic acid molecule and/or polypeptide in the cells into which it is delivered. Viral vectors are, for example, Adenovirus, Adeno-associated virus, herpes virus, Vaccinia virus, Polio virus, Sindbis, and other RNA viruses, including these viruses with the HIV backbone. Also preferred are any viral families which share the properties of these viruses which make them suitable for use as vectors. Retroviral vectors, in general are described by Coffin et al., Retroviruses, Cold Spring Harbor Laboratory Press (1997), which is incorporated by reference herein for the vectors and methods of making them. The construction of replication-defective adenoviruses has been described (Berkner et al., J. Virol. 61:1213-20 (1987); Massie et al., Mol. Cell. Biol. 6:2872-83 (1986); Haj-Ahmad et al., J. Virol. 57:267-74 (1986); Davidson et al., J. Virol. 61:1226-39 (1987); Zhang et al., BioTechniques 15:868-72 (1993)). The benefit and the use of these viruses as vectors is that they are limited in the extent to which they can spread to other cell types, since they can replicate within an initial infected cell, but are unable to form new infectious viral particles. Recombinant adenoviruses have been shown to achieve high efficiency after direct, in vivo delivery to airway epithelium, hepatocytes, vascular endothelium, CNS parenchyma, and a number of other tissue sites. Other useful systems include, for example, replicating and host-restricted non-replicating vaccinia virus vectors.

The provided polypeptides and/or nucleic acid molecules can be delivered via virus like particles. Virus like particles (VLPs) consist of viral protein(s) derived from the structural proteins of a virus. Methods for making and using virus like particles are described in, for example, Garcea and Gissmann, Current Opinion in Biotechnology 15:513-7 (2004).

The provided polypeptides can be delivered by subviral dense bodies (DBs). DBs transport proteins into target cells by membrane fusion. Methods for making and using DBs are described in, for example, Pepperl-Klindworth et al., Gene Therapy 10:278-84 (2003).

The provided polypeptides can be delivered by tegument aggregates. Methods for making and using tegument aggregates are described in International Publication No. WO 2006/110728.

Non-viral based delivery methods can include expression vectors comprising nucleic acid molecules and nucleic acid sequences encoding polypeptides, wherein the nucleic acids are operably linked to an expression control sequence. Suitable vector backbones include, for example, those routinely used in the art such as plasmids, artificial chromosomes, BACs, YACs, or PACs. Numerous vectors and expression systems are commercially available from such corporations as Novagen (Madison, Wis.), Clonetech (Pal Alto, Calif.), Stratagene (La Jolla, Calif.), and Invitrogen/Life Technologies (Carlsbad, Calif.). Vectors typically contain one or more regulatory regions. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, and introns. Such vectors can also be used to make the chimeric polypeptides by expression is a suitable host cell, such as CHO cells.

Preferred promoters controlling transcription from vectors in mammalian host cells may be obtained from various sources, for example, the genomes of viruses such as polyoma, Simian Virus 40 (SV40), adenovirus, retroviruses, hepatitis B virus, and most preferably cytomegalovirus (CMV), or from heterologous mammalian promoters, e.g. β-actin promoter or EF1α promoter, or from hybrid or chimeric promoters (e.g., CMV promoter fused to the β-actin promoter). Of course, promoters from the host cell or related species are also useful herein.

Enhancer generally refers to a sequence of DNA that functions at no fixed distance from the transcription start site and can be either 5' or 3' to the transcription unit. Furthermore, enhancers can be within an intron as well as within the coding sequence itself. They are usually between 10 and 300 base pairs (bp) in length, and they function in cis. Enhancers usually function to increase transcription from nearby promoters. Enhancers can also contain response elements that mediate the regulation of transcription. While many enhancer sequences are known from mammalian genes (globin, elastase, albumin, fetoprotein, and insulin), typically one will use an enhancer from a eukaryotic cell virus for general expression. Preferred examples are the SV40 enhancer on the late side of the replication origin, the cytomegalovirus early promoter enhancer, the polyoma enhancer on the late side of the replication origin, and adenovirus enhancers.

The promoter and/or the enhancer can be inducible (e.g. chemically or physically regulated). A chemically regulated promoter and/or enhancer can, for example, be regulated by the presence of alcohol, tetracycline, a steroid, or a metal. A physically regulated promoter and/or enhancer can, for example, be regulated by environmental factors, such as temperature and light. Optionally, the promoter and/or enhancer region can act as a constitutive promoter and/or enhancer to maximize the expression of the region of the transcription unit to be transcribed. In certain vectors, the promoter and/or enhancer region can be active in a cell type specific manner. Optionally, in certain vectors, the promoter and/or enhancer region can be active in all eukaryotic cells, independent of cell type. Preferred promoters of this type are the CMV promoter, the SV40 promoter, the β-actin promoter, the EF1α promoter, and the retroviral long terminal repeat (LTR).

The vectors also can include, for example, origins of replication and/or markers. A marker gene can confer a selectable phenotype, e.g., antibiotic resistance, on a cell. The marker product is used to determine if the vector has been delivered to the cell and once delivered is being expressed. Examples of selectable markers for mammalian cells are dihydrofolate reductase (DHFR), thymidine kinase, neomycin, neomycin analog G418, hygromycin, puromycin, and blasticidin. When such selectable markers are successfully transferred into a mammalian host cell, the transformed mammalian host cell can survive if placed under selective pressure. Examples of other markers include, for example, the E. coli lacZ gene, green fluorescent protein (GFP), and luciferase. In addition, an expression vector can include a tag sequence designed to facilitate manipulation or detection (e.g., purification or localization) of the expressed polypeptide. Tag sequences, such as GFP, glutathione S-transferase (GST), polyhistidine, c-myc, hemagglutinin, or FLAG™ tag (Kodak; New Haven, Conn.) sequences typically are expressed as a fusion with the encoded polypeptide. Such tags can be inserted anywhere within the polypeptide including at either the carboxyl or amino terminus.

As used herein, the terms peptide, polypeptide, or protein are used broadly to mean two or more amino acids linked by a peptide bond. Protein, peptide, and polypeptide are also used herein interchangeably to refer to amino acid sequences. It should be recognized that the term polypeptide is not used herein to suggest a particular size or number of amino acids comprising the molecule and that a peptide of the invention can contain up to several amino acid residues or more. As used throughout, subject can be a vertebrate, more specifically a mammal (e g a human, horse, cat, dog, cow, pig, sheep, goat, mouse, rabbit, rat, and guinea pig), birds, reptiles, amphibians, fish, and any other animal. The term does not denote a particular age or sex. Thus, adult and newborn subjects, whether male or female, are intended to be covered. As used herein, patient or subject may be used interchangeably and can refer to a subject with a disease or disorder (e.g. cancer). The term patient or subject includes human and veterinary subjects.

A subject at risk of developing a disease or disorder can be genetically predisposed to the disease or disorder, e.g., have a family history or have a mutation in a gene that causes the disease or disorder, or show early signs or symptoms of the disease or disorder. A subject currently with a disease or disorder has one or more than one symptom of the disease or disorder and may have been diagnosed with the disease or disorder.

The methods and agents as described herein are useful for both prophylactic and therapeutic treatment. For prophylactic use, a therapeutically effective amount of the chimeric polypeptides or chimeric nucleic acid sequences encoding the chimeric polypeptides described herein are administered to a subject prior to onset (e.g., before obvious signs of cancer or inflammation) or during early onset (e.g., upon initial signs and symptoms of cancer or inflammation). Prophylactic administration can occur for several days to years prior to the manifestation of symptoms of cancer or inflammation. Prophylactic administration can be used, for example, in the preventative treatment of subjects diagnosed with a genetic predisposition to cancer. Therapeutic treatment involves administering to a subject a therapeutically effective amount of the chimeric polypeptides or nucleic acid sequences encoding the chimeric polypeptides described herein after diagnosis or development of cancer or inflammation (e.g., an autoimmune disease). Prophylactic use may also apply when a patient is undergoing a treatment, e.g., a chemotherapy, in which inflammation is expected.

According to the methods taught herein, the subject is administered an effective amount of the agent (e.g., a chimeric polypeptide). The terms effective amount and effective dosage are used interchangeably. The term effective amount is defined as any amount necessary to produce a desired physiologic response. Effective amounts and schedules for administering the agent may be determined empirically, and making such determinations is within the skill in the art. The dosage ranges for administration are those large enough to produce the desired effect in which one or more symptoms of the disease or disorder are affected (e.g., reduced or delayed). The dosage should not be so large as to cause substantial adverse side effects, such as unwanted cross-reactions, anaphylactic reactions, and the like. Generally, the dosage will vary with the age, condition, sex, type of disease, the extent of the disease or disorder, route of administration, or whether other drugs are included in the regimen, and can be determined by one of skill in the art. The dosage can be adjusted by the individual physician in the event of any contraindications. Dosages can vary and can be administered in one or more dose administrations daily, for one or several days. Guidance can be found in the literature for appropriate dosages for given classes of pharmaceutical products.

As used herein the terms treatment, treat, or treating refers to a method of reducing the effects of a disease or condition or symptom of the disease or condition. Thus, in the disclosed method, treatment can refer to a 10%, 20%, 30%, 40%, 50%, 60%, 70%, 80%, 90%, or 100% reduction in the severity of an established disease or condition or symptom of the disease or condition. For example, a method for treating a disease is considered to be a treatment if there is a 10% reduction in one or more symptoms of the disease in a subject as compared to a control. Thus, the reduction can be a 10%, 20%, 30%, 40%, 50%, 60%, 70%, 80%, 90%, 100%, or any percent reduction in between 10% and 100% as compared to native or control levels. It is understood that treatment does not necessarily refer to a cure or complete ablation of the disease, condition, or symptoms of the disease or condition.

As used herein, the terms prevent, preventing, and prevention of a disease or disorder refers to an action, for example, administration of the chimeric polypeptide or nucleic acid sequence encoding the chimeric polypeptide, that occurs before or at about the same time a subject begins to show one or more symptoms of the disease or disorder, which inhibits or delays onset or exacerbation of one or more symptoms of the disease or disorder. As used herein, references to decreasing, reducing, or inhibiting include a change of 10%, 20%, 30%, 40%, 50%, 60%, 70%, 80%, 90% or greater as compared to a control level. Such terms can include but do not necessarily include complete elimination.

IL-2 variants have been developed that are selective for IL2Rαβγ relative to IL2Rβγ (Shanafelt, A. B., et al., 2000, Nat Biotechnol. 18:1197-202; Cassell, D. J., et. al., 2002, Curr Pharm Des., 8:2171-83). These variants have amino acid substitutions which reduce their affinity for IL2RB. Because IL-2 has undetectable affinity for IL2RG, these variants consequently have reduced affinity for the IL2Rβγ receptor complex and reduced ability to activate IL2Rβγ-expressing cells but retain the ability to bind IL2RA and the ability to bind and activate the IL2Rαβγ receptor complex.

One of these variants, IL2/N88R (Bay 50-4798), was clinically tested as a low-toxicity version of IL-2 as an immune system stimulator, based on the hypothesis that IL2Rβγ-expressing NK cells are a major contributor to toxicity. Bay 50-4798 was shown to selectively stimulate the proliferation of activated T cells relative to NK cells, and was evaluated in phase I/II clinical trials in cancer patients (Margolin, K., et. al., 2007, Clin Cancer Res., 13:3312-9) and HIV patients (Davey, R. T., et. al., 2008, J Interferon Cytokine Res., 28:89-100). These clinical trials showed that Bay 50-4798 was considerably safer and more tolerable than aldesleukin, and also showed that it increased the levels of CD4+CD25+ T cells, a cell population enriched in Treg cells. Subsequent to these trials, research in the field more fully established the identity of Treg cells and demonstrated that Treg cells selectively express IL2Rαβγ(reviewed in Malek, T. R., et al., 2010, Immunity, 33:153-65). Based on this new research, it can now be understood that IL2Rαβγ selective agonists should be selective for Treg cells.

In addition, mutants can be made that selectively alter the affinity for the CD25 chain relative to native 11-2.

IL-2 can be engineered to produce mutants that bind the IL-2R complex generally or the IL-2Rα subunit specifically with an affinity that differs from that of the corresponding wild-type IL-2 or of a presently available mutant (referred to as C125 S, as the cysteine residue at position 125 is replaced with a serine residue).

Accordingly, the present invention features mutant interleukin-2 (IL-2*) polypeptides that include an amino acid sequence that is at least 80% identical to wild-type IL-2 (e.g., 85, 87, 90, 95, 97, 98, or 99% identical) and that bind, as compared to WT IL-2, with higher to the IL-2 trimeric receptor relative to the dimeric IL-2 receptor. Typically, the muteins will also bind an IL-2 receptor a subunit (IL-2Rα) with an affinity that is greater than the affinity with which wild type IL-2 binds the IL-2Rα. The amino acid sequence within mutant IL-2 polypeptides can vary from SEQ ID NO:1 (UniProtKB accession number P60568) by virtue of containing (or only containing) one or more amino acid substitutions, which may be considered conservative or non-conservative substitutions. Non-naturally occurring amino acids can also be incorporated. Alternatively, or in addition, the amino acid sequence can vary from SEQ ID NO:1 (which may be considered the "reference" sequence) by virtue of containing and addition and/or deletion of one or more amino acid residues. More specifically, the amino acid sequence can differ from that of SEQ ID NO:1 by virtue of a mutation at least one of the following positions of SEQ ID NO:1: 1, 4, 8, 9, 10, 11, 13, 15, 26, 29, 30, 31, 35, 37, 46, 48, 49, 54, 61, 64, 67, 68, 69, 71, 73, 74, 75, 76, 79, 88, 89, 90, 92, 99, 101, 103, 114, 125, 128, or 133 (or combinations thereof). As noted, as few as one of these positions may be altered, as may two, three, four, five, six, seven, eight, nine, ten, or 11 or more (including up to all) of the positions. For example, the amino acid sequence can differ from SEQ ID NO:1 at positions 69 and 74 and further at one or more of positions 30, 35, and 128. The amino acid sequence can also differ from SEQ ID NO:2 (as disclosed in U.S. Pat. No. 7,569,215, incorporated herein by reference) at one of the following sets of positions: (a) positions 64, 69, and 74; (b) positions 69, 74, and 101; (c) positions 69, 74, and 128; (d) positions 30, 69, 74, and 103; (e) positions 49, 69, 73, and 76; (f) positions 69, 74, 101, and 133; (g) positions 30, 69, 74, and 128; (h) positions 69, 74, 88, and 99; (i) positions 30, 69, 74, and 128; (j) positions 9, 11, 35, 69, and 74; (k) positions 1, 46, 49, 61, 69, and 79; (l) positions 48, 68, 71, 90, 103, and 114; (m) positions 4, 10, 11, 69, 74, 88, and 133; (n) positions 15, 30 31, 35, 48, 69, 74, and 92; (0) positions 30, 68, 69, 71, 74, 75, 76, and 90; (p) positions 30, 31, 37, 69, 73, 74, 79, and 128; (q) positions 26, 29, 30, 54, 67, 69, 74, and 92; (r) positions 8, 13, 26, 30, 35, 37, 69, 74, and 92; and (s) positions 29, 31, 35, 37, 48, 69, 71, 74, 88, and 89. Aside from mutations at these positions, the amino acid sequence of the mutant IL-2 polypeptide can otherwise be identical to SEQ ID NO:1. With respect to specific substitutions, the amino acid sequence can differ from SEQ ID NO:1 by virtue of having one or more of the following mutations: AlT, S4P, K8R, K9T, T10A, Q11R, Q13R, E15K, N26D, N29S, N30S, N30D, N30T, Y31H, Y31C, K35R, T37A, T37R, M46L, K48E, K49R, K49E, K54R, E61D, K64R, E67G, E68D, V69A, N71T, N71A, N71R, A73V, Q74P, S75P, K76E, K76R, H79R, N88D, I89V, N90H, I92T, S99P, T101A, F103S, I114V, I128T, I128A, T133A, or T133N. Our nomenclature is consistent with that of the scientific literature, where the single letter code of the amino acid in the wild-type or reference sequence is followed by its position within the sequence and then by the single letter code of the amino acid with which it is replaced. Thus, AlT designates a substitution of the alanine residue a position 1 with threonine. Other mutant polypeptides within the scope of the invention include those that include a mutant of SEQ ID NO:2 having substitutions at V69 (e.g. A) and Q74 (e.g., P). For example, the amino acid sequence can include one of the following sets of mutations with respect to SEQ ID NO:2: (a) K64R, V69A, and Q74P; (b) V69A, Q74P, and T101A; (c) V69A, Q74P, and I128T; (d) N30D, V69A, Q74P, and F103S; (e) K49E, V69A, A73V, and K76E; (f) V69A, Q74P, T101A, and T133N; (g) N30S, V69A, Q74P, and I128A; (h) V69A, Q74P, N88D, and S99P; (i) N30S, V69A, Q74P, and I128T; (j) K9T, Q11R, K35R, V69A, and Q74P; (k) AlT, M46L, K49R, E61D, V69A, and H79R; (l) K48E, E68D, N71T, N90H, F103S, and I114V; (m) S4P, T10A, Q11R, V69A, Q74P, N88D, and T133A; (n) E15K, N30S Y31H, K35R, K48E, V69A, Q74P, and I92T; (o) N30S, E68D, V69A, N71A, Q74P, S75P, K76R, and N90H; (p) N30S, Y31C, T37A, V69A, A73V, Q74P, H79R, and I128T; (q) N26D, N29S, N30S, K54R, E67G, V69A, Q74P, and I92T; (r) K8R, Q13R, N26D, N30T, K35R, T37R, V69A, Q74P, and I92T; and (s) N29S, Y31H, K35R, T37A, K48E, V69A, N71R, Q74P, N88D, and I89V. SEQ ID NO:2 is disclosed in U.S. Pat. No. 7,569,215, which is incorporated herein by reference as an exemplary IL-2 polypeptide sequence that can be used in the invention.

As noted above, any of the mutant IL-2 polypeptides disclosed herein can include the sequences described; they can also be limited to the sequences described and otherwise identical to SEQ ID NO:1. Moreover, any of the mutant IL-2 polypeptides described herein can optionally include a substitution of the cysteine residue at position 125 with another residue (e.g., serine) and/or can optionally include a deletion of the alanine residue at position 1 of SEQ ID NO:1.

The mutant IL-2 polypeptides disclosed herein can bind to the IL-2Rα subunit with a $K_d$ of less than about 28 nM (e.g., less than about 25 nM; less than about 5 nM; about 1 nM; less than about 500 pM; or less than about 100 pM). More specifically, a mutant IL-2 polypeptide can have an affinity equilibrium constant less than 1.0 nM (e.g., about 0.8, 0.6, 0.4, or 0.2 nM). Affinity can also be expressed as a relative rate of dissociation from an IL-2Rα subunit or from an IL-2 receptor complex (e.g., a complex expressed on the surface of a cell or otherwise membrane bound). For example, the mutant IL-2 polypeptides can dissociate from, e.g., IL-2Rα, at a decreased rate relative to a wild-type polypeptide or to an IL-2 based therapeutic, e.g., IL-2*. Alternatively, affinity can be characterized as the time, or average time, an IL-2* polypeptide persists on, for example, the surface of a cell expressing an IL-2R. For example, an IL-2*polypeptide can persist on the receptor for at least about 2, 5, 10, 50, 100, or 250 times (or more).

Disclosed are materials, compositions, and components that can be used for, can be used in conjunction with, can be used in preparation for, or are products of the disclosed methods and compositions. These and other materials are disclosed herein, and it is understood that when combinations, subsets, interactions, groups, etc. of these materials are disclosed that while specific reference of each various individual and collective combinations and permutations of these compounds may not be explicitly disclosed, each is specifically contemplated and described herein. For example, if a method is disclosed and discussed and a number of modifications that can be made to a number of molecules including the method are discussed, each and every combination and permutation of the method, and the modifications that are possible are specifically contemplated unless specifically indicated to the contrary. Likewise, any subset or combination of these is also specifically contemplated and disclosed. This concept applies to all aspects of this disclosure including, but not limited to, steps in methods using the disclosed compositions. Thus, if there are a variety of additional steps that can be performed, it is understood that each of these additional steps can be performed with any specific method steps or combination of method steps of the disclosed methods, and that each such combination or subset of combinations is specifically contemplated and should be considered disclosed.

Publications cited herein and the material for which they are cited are hereby specifically incorporated by reference in their entireties.

6. INCORPORATION BY REFERENCE

All publications, patents, and patent applications mentioned in this specification are herein incorporated by reference to the same extent as if each individual publication, patent, or patent application was specifically and individually indicated to be incorporated by reference. However, the citation of a reference herein should not be construed as an acknowledgement that such reference is prior art to the present invention. To the extent that any of the definitions or terms provided in the references incorporated by reference differ from the terms and discussion provided herein, the present terms and definitions control.

7. EXAMPLES

The following are examples of methods and compositions of the invention. It is understood that various other embodiments may be practiced, given the general description provided herein.

Example 1. Detection of IL-2, IL-2 Mutein, IL-2Rα and IL-2Rγ in Fusion Proteins by ELISA IL-2 mutein is detected with a commercially available antibody, e.g., the anti-IL-2 monoclonal (JES6-1A12) (BD Pharmingen; San Jose, Calif.). A positive control is used to show whether the monoclonal antibody recognizes the cytokine or mutein. Antibodies against IL-2Rα and IL-2Rγ chain are also used. Wells of a 96-well plate are coated with an antibody (2.5 µg/ml) in PBS. Wells are blocked with 5% non-fat milk in PBS with 0.2% Tween®20 (PBS-M-Tw) and fusion proteins are added for 1-2 hours at 37° C. After washing, an anti-IL-2 biotin-labeled antibody, e.g., JES5H4 (BD Pharmingen) is added and binding is detected using Streptavidin HRP (Southern Biotechnology Associates; Birmingham, Ala.). The ELISA plate is developed by adding 50 µl O-phenylenediamine (OPD) (Sigma-Aldrich) in 0.1M Citrate pH 4.5 and 0.04% $H_2O_2$, stopped by adding 50 µl/well 2N $H_2SO_4$ and the absorbance was read at 490 nm.

Example 2: Protease Cleavage of Fusion Protein by MMP9 Protease

One of skill in the art would be familiar with methods of setting up protein cleavage assay. 100 µg of protein in 1×PBS pH 7.4 were cleaved with 1 µg active MMP9 (Sigma catalog #SAE0078-50 or Enzo catalog BML-SE360) and incubated at room temperature for up to 16 hours. Digested protein is subsequently used in functional assays or stored at −80° C. prior to testing. Extent of cleavage was monitored by SDS PAGE using methods well known in the art. As shown in FIGS. 10, 13, 18A, 18b, and 27A full cleavage of the fusion proteins by MMP9 protease is seen.

Example 3: CTLL-2 Assay

CTLL2 cells (ATCC) were plated in suspension at a concentration of 500,000 cells/well in culture media with or without 40 mg/ml human serum albumin (HSA) and stimulated with a dilution series of recombinant hIL2 or activatable hIL2 for 72 hours at 37° C. and 5% $CO_2$. Activity of uncleaved and cleaved activatable hIL2 was tested. Cleaved activatable hIL2 was generated by incubation with active MMP9. Cell activity was assessed using a CellTiter-Glo® (Promega) luminescence-based cell viability assay. Results are shown in FIGS. 8A-8F, FIGS. 9A-9Z, FIG. 25C.

Example 4: Protease Cleavage of the IL-2/IL-2Rα/IL-2Rγ Chimeric Polypeptide Results in Increased Accessibility to Antibodies and Biologically Active IL-2 Mutein The IL-2 mutein fusion proteins are biochemically characterized before and after cleavage with a protease, e.g., PSA Immunoblot analyses will show that the fusion proteins can be cleaved by PSA and that there is an increase in intensity of the predicted low molecular weight cleavage product of approximately 20 kDa reactive with an anti-IL-2 antibody after treatment of the samples with PSA. The degree of cleavage is dependent upon the amount of PSA as well as the time of incubation. Interestingly, when the fusion protein is analyzed before and after PSA treatment by ELISA, it was found that the apparent amount of IL-2 is increased after PSA cleavage. In this experiment, there is an approximately 2 or 4-fold increase in the apparent amount of IL-2 detected using this sandwich ELISA depending on the construct, suggesting that the antibody binding is partially hindered in the intact fusion protein. Aliquots of the same samples are also analyzed after PSA treatment using the CTLL-2 cell line that requires IL-2 for growth and survival and the viability of cells can be ascertained using the colorimetric MTT assay. In this assay, the more a supernatant can be diluted, the more biologically active IL-2 it contains, and there is an increase in the amount of biologically active IL-2 after PSA cleavage. The amount of IL-2 mutein increase will suggest that after PSA cleavage there is an increase in the predicted low molecular weight cleavage fragment of approximately 20 kDa reactive with an anti-IL-2 antibody, an increase in antibody accessibility, and most importantly, an increase in the amount of biologically active IL-2 mutein.

Example 5. In Vivo Delivery of a Protease Activated Fusion Protein Results in Decreased Tumor Growth The chimeric polypeptide is examined to determine if it could have biological effects in vivo. For these experiments a system is used in which tumor cells injected intraperitoneally rapidly and preferentially attach and grow initially on the milky spots, a series of organized immune aggregates found on the omentum (Gerber et al., Am. J. Pathol. 169: 1739-52 (2006)). This system offers a convenient way to examine the effects of fusion protein treatment on tumor growth since fusion proteins can be delivered intraperitoneally multiple times and tumor growth can be analyzed by examining the dissociated omental cells. For these experiments, the Colon 38 cell line, a rapidly growing tumor cell line that expresses both MMP2 and MMP9 in vitro, may be used. The omental tissue normally expresses a relatively small amount of MMP2 and MMP9, but, when Colon 38 tumor is present on the omentum, MMP levels increase. Using this tumor model, the ability of IL-2 mutein fusion proteins to affect tumor growth is examined Colon 38 cells are injected intraperitoneally, allowed to attach and grow for 1 day, and then treated daily with fusion protein intraperitoneally. At day 7, the animals are sacrificed and the omenta examined for tumor growth using flow cytometry and by a colony-forming assay.

Example 6: Determination of Antigen Affinity by Flow Cytometry

Activatable interleukin proteins are tested for their binding affinities to human $CD20^+$ cells and cynomolgus $CD20^+$ cells.
$CD20^+$ cells are incubated with 100 µL of serial dilutions of the activatable interleukin proteins and at least one protease. After washing three times with FACS buffer the cells are incubated with 0.1 mL of 10 µg/mL mouse monoclonal anti-idiotype antibody in the same buffer for 45 min on ice. After a second washing cycle, the cells are incubated with 0.1 mL of 15 µg/mL FITC-conjugated goat anti-mouse IgG antibodies under the same conditions as before. As a control, cells are incubated with the anti-His IgG followed by the FITC-conjugated goat anti-mouse IgG antibodies without the activatable IL2 proteins. The cells were then washed again and resuspended in 0.2 mL of FACS buffer containing 2 µg/mL propidium iodide (PI) in order to exclude dead cells. The fluorescence of $1 \times 10^4$ living cells is measured using a Beckman-Coulter FC500 MPL flow cytometer using the MXP software (Beckman-Coulter, Krefeld, Germany) or a Millipore Guava EasyCyte flow cytometer using the Incyte software (Merck Millipore, Schwalbach, Germany). Mean fluorescence intensities of the cell samples are calculated using CXP software (Beckman-Coulter, Krefeld, Germany) or Incyte software (Merck Millipore, Schwalbach, Germany). After subtracting the fluorescence intensity values of the cells stained with the secondary and tertiary reagents alone the values are then used for calculation of the $K_D$ values with the equation for one-site binding (hyperbola) of the GraphPad Prism (version 6.00 for Windows, GraphPad Software, La Jolla Calif. USA).

CD20 binding and crossreactivity are assessed on the human CD20⁺ tumor cell lines. The $K_D$ ratio of crossreactivity is calculated using the $K_D$ values determined on the CHO cell lines expressing either recombinant human or recombinant cynomolgus antigens.

Example 7: Cytotoxicity Assay

Activatable interleukin protein is evaluated in vitro on its mediation of immune response to CD20⁺ target cells.

Fluorescence labeled CD20⁺ REC-1 cells (a Mantle cell lymphoma cell line, ATCC CRL-3004) are incubated with isolated PBMC of random donors or CB15 T-cells (standardized T-cell line) as effector cells in the presence of the activatable IL2 protein and at least one protease. After incubation for 4 h at 37° C. in a humidified incubator, the release of the fluorescent dye from the target cells into the supernatant is determined in a spectro-fluorimeter. Target cells incubated without the activatable IL2 protein and target cells totally lysed by the addition of saponin at the end of the incubation serve as negative and positive controls, respectively.

Based on the measured remaining living target cells, the percentage of specific cell lysis is calculated according to the following formula: [1-(number of living targets$_{(sample)}$/number of living targets$_{(spontaneous)}$)]×100%. Sigmoidal dose response curves and EC50 values are calculated by non linear regression/4-parameter logistic fit using the GraphPad Software. The lysis values obtained for a given antibody concentration are used to calculate sigmoidal dose-response curves by 4 parameter logistic fit analysis using the Prism® GraphPad® software.

Example 8: Pharmacokinetics of Activatable Interleukin Proteins

Activatable interleukin protein is evaluated for half-time elimination in animal studies.

The activatable IL2 protein is administered to cynomolgus monkeys as a 0.5 mg/kg bolus injection into the saphenous vein. Another cynomolgus monkey group receives a comparable IL2 construct in size but lacking a serum half-life extension element. A third and fourth group receive an IL2 construct with serum half-life extension element and a cytokine with CD20 and serum half-life extension elements respectively, and both comparable in size to the activatable interleukin protein. Each test group consists of 5 monkeys. Serum samples are taken at indicated time points, serially diluted, and the concentration of the proteins is determined using a binding ELISA to CD20.

Pharmacokinetic analysis is performed using the test article plasma concentrations. Group mean plasma data for each test article conforms to a multi-exponential profile when plotted against the time post-dosing. The data are fit by a standard two-compartment model with bolus input and first-order rate constants for distribution and elimination phases. The general equation for the best fit of the data for i.v. administration is: $c(t)=Ae^{-\alpha t}+ Be^{-\beta t}$, where c(t) is the plasma concentration at time t, A and B are intercepts on the Y-axis, and a and l3 are the apparent first-order rate constants for the distribution and elimination phases, respectively. The α-phase is the initial phase of the clearance and reflects distribution of the protein into all extracellular fluid of the animal, whereas the second or β-phase portion of the decay curve represents true plasma clearance. Methods for fitting such equations are well known in the art. For example, A=D/V(α-k21)/(α-β), B=D/V(β-k21)/(α-β), and a and β (for α>β) are roots of the quadratic equation: $r^2+(k12+k21+k10)r+k21k10=0$ using estimated parameters of V=volume of distribution, k10=elimination rate, k12=transfer rate from compartment 1 to compartment 2 and k21=transfer rate from compartment 2 to compartment 1, and D=the administered dose.

Data analysis: Graphs of concentration versus time profiles are made using KaleidaGraph (KaleidaGraph™ V. 3.09 Copyright 1986-1997. Synergy Software. Reading, Pa.). Values reported as less than reportable (LTR) are not included in the PK analysis and are not represented graphically. Pharmacokinetic parameters are determined by compartmental analysis using WinNonlin software (WinNonlin® Professional V. 3.1 WinNonlin™ Copyright 1998-1999. Pharsight Corporation. Mountain View, Calif.). Pharmacokinetic parameters are computed as described in Ritschel W A and Kearns G L, 1999, IN: *Handbook of Basic Pharmacokinetics Including Clinical Applications,* 5th edition, American Pharmaceutical Assoc., Washington, D.C.

It is expected that the activatable interleukin protein has improved pharmacokinetic parameters such as an increase in elimination half-time as compared to proteins lacking a serum half-life extension element.

Example 9: Xenograft Tumor Model

Activatable IL2 protein is evaluated in a xenograft model.

Female immune-deficient NOD/scid mice are sub-lethally irradiated (2 Gy) and subcutaneously inoculated with 4×10⁶ Ramos RA1 cells into the right dorsal flank. When tumors reach 100 to 200 mm³, animals are allocated into 3 treatment groups. Groups 2 and 3 (8 animals each) are intraperitoneally injected with 1.5×10⁷ activated human T-cells. Three days later, animals from Group 3 are subsequently treated with a total of 9 intravenous doses of 50 µg activatable interleukin protein. Groups 1 and 2 are only treated with vehicle. Body weight and tumor volume are determined for 30 days.

It is expected that animals treated with the activatable interleukin protein have a statistically significant delay in tumor growth in comparison to the respective vehicle-treated control group.

Example 10: Mouse IFNγ WEHI Cell Survival Assay

WEHI279 cells (ATCC) were plated in suspension at a concentration of 25,000 cells/well in culture media with or without 1.5% human serum albumin (HSA) and stimulated with a dilution series of recombinant mIFNγ or inducible mIFNγ for 72 hours at 37° C. and 5% $CO_2$. Activity of uncleaved and cleaved inducible mIFNγ was tested. Cleaved inducible mIFNγ was generated by incubation with active MMP9. Cell survival was assessed using a CellTiter-Glo (Promega) luminescence-based cell viability assay. The EC50 values for cleaved inducible mIFNγ molecules were at least 100× more potent than un-cleaved inducible mIFNγ molecules. As shown in FIGS. 16A-16, greater inducibility was seen in assays wherein the culture medium contained human serum albumin.

Example 11: Reserved

Example 12: Mouse IFNγ B16 Reporter Cell Assay

Figure 20B:
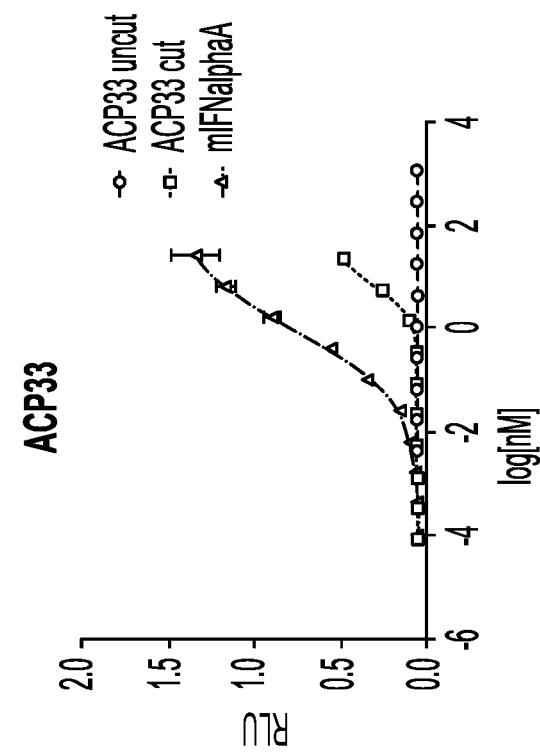
Figure 20A:
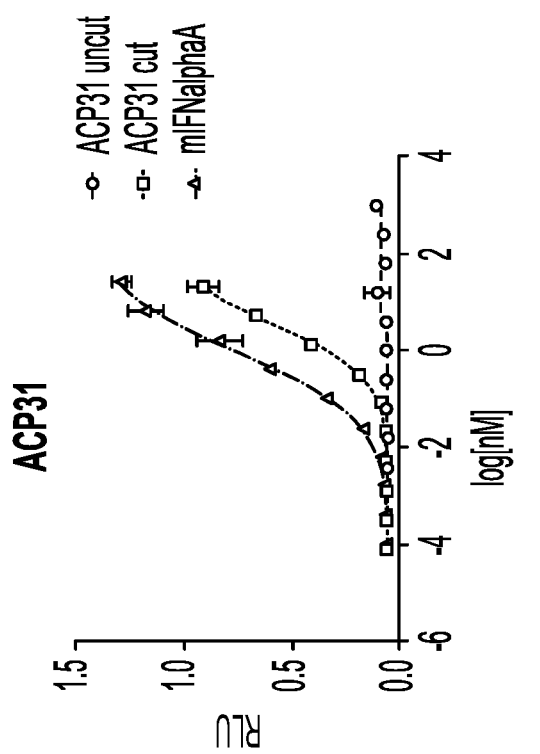
Figures 22A, 22B:
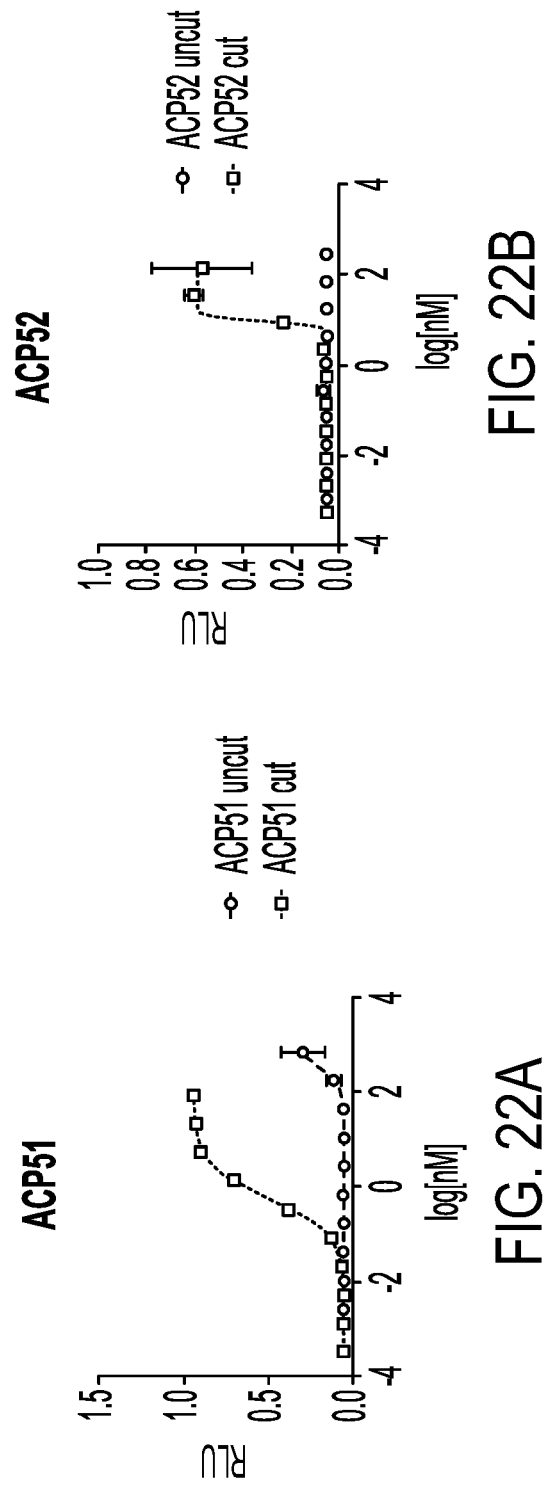
FIGS. 22A-22B are a series of graphs showing activity of exemplary IFNγ fusion proteins (ACP51 and ACP52) cleaved by MMP9 protease compared to activity of uncleaved fusion proteins using B16 reporter assay. Each fusion protein comprises an anti-HSA binder and a tumor targeting domain.
Figure 23B:
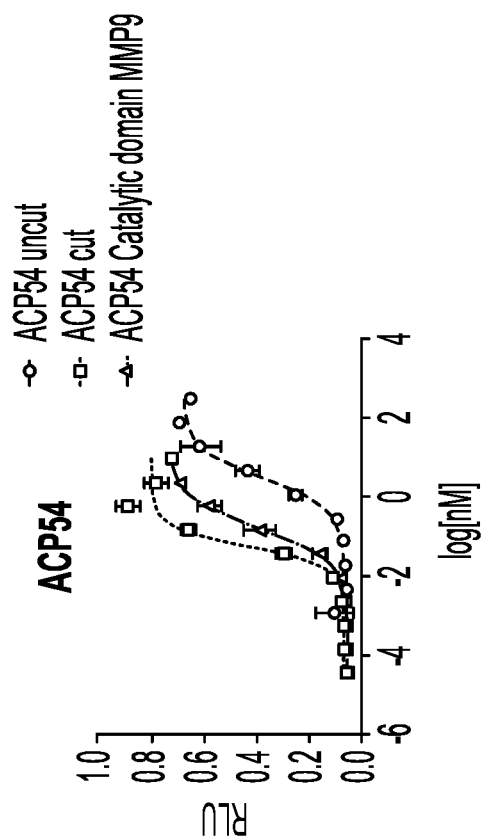
FIGS. 23A-23B are a series of graphs showing activity of exemplary IFNγ fusion proteins (ACP53 and ACP54) cleaved by MMP9 protease compared to activity of uncleaved fusion proteins using B16 reporter assay. Each fusion protein comprises IFNγ directly fused to albumin.
Figure 23A:
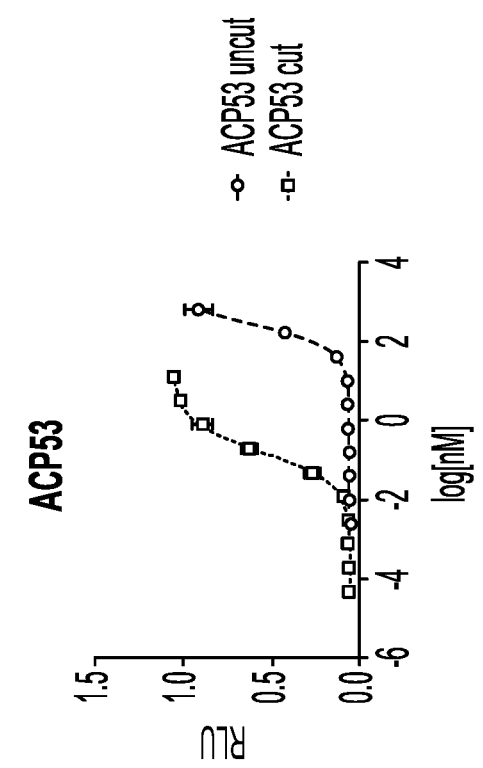

B16-Blue IFNγ cells (InvivoGen) were plated at a concentration of 75,000 cells/well in culture media with or without 1.5% human serum albumin (HSA) and stimulated with a dilution series of recombinant mIFNγ or inducible mIFNγ for 24 hours at 37° C. and 5% $CO_2$. Activity of uncleaved and cleaved inducible mIFNγ was tested. Cleaved inducible mIFNγ was generated by incubation with active MMP9. Supernatants were harvested, and SEAP activation was assessed by adding QUANTI-Blue Reagent (InvivoGen), incubating at 37° C. for 2 hours, and measuring absorbance at 620 nm. The EC50 values for cleaved inducible mIFNγ molecules were at least 100× more potent than un-cleaved inducible mIFNγ molecules. Results are shown in e.g., FIG. 19A-19B, FIGS. 22A-22B, FIGS. 23A-23B. This experiment was repeated with for IFNα conjugates using B16-Blue IFNα/β cells. The EC50 values for cleaved inducible mIFNα molecules were at least 100× more potent than un-cleaved inducible mIFNα molecules. See FIGS. 20A-20B.

Example 13. In Vivo Delivery of a Protease Activated Fusion Protein Results in Decreased Tumor Growth The chimeric polypeptide is examined to determine if it could have biological effects in vivo. For these experiments a system is used in which tumor cells injected intraperitoneally rapidly and preferentially attach and grow initially on the milky spots, a series of organized immune aggregates found on the omentum (Gerber et al., Am. J. Pathol. 169: 1739-52 (2006)). This system offers a convenient way to examine the effects of fusion protein treatment on tumor growth since fusion proteins can be delivered intraperitoneally multiple times and tumor growth can be analyzed by examining the dissociated omental cells. For these experiments, the Colon 38 cell line, a rapidly growing tumor cell line that expresses both MMP2 and MMP9 in vitro, may be used. The omental tissue normally expresses a relatively small amount of MMP2 and MMP9, but, when Colon 38 tumor is present on the omentum, MMP levels increase. Using this tumor model, the ability of IFN fusion proteins to affect tumor growth is examined Colon 38 cells are injected intraperitoneally, allowed to attach and grow for 1 day, and then treated daily with fusion protein intraperitoneally. At day 7, the animals are sacrificed and the omenta examined for tumor growth using flow cytometry and by a colony-forming assay.

Example 14: The Chimeric Polypeptide was Examined to Determine its Biological Effects In Vivo The MC38 cell line, a rapidly growing colon adenocarcinoma cell line that expresses MMP9 in vitro, was used. Using this tumor model, the ability of IFNγ fusion proteins to affect tumor growth was examined MC38 cells were injected subcutaneously, allowed to grow for 10-14 days, and then treated with fusion protein twice weekly intraperitoneally for a total of four doses. As a comparator, wild type mIFNγ was administered at the dose levels indicated, twice daily for 2 weeks on a 5 day on/2 day off schedule (10 total doses). Tumor growth and body weight were monitored approximately twice per week for two weeks.

Example 15: Construction of an Exemplary IFNγ Protein Targeting CD20

15.1 Generation of an Activatable Cytokine Domain

An IFNγ polypeptide capable of binding to CD20 polypeptide present in a tumor or on a tumor cell is produced as follows. A nucleic acid is produced that contains nucleic acid sequences: (1) encoding an IFNγ polypeptide sequence and (2) one or more polypeptide linkers. Activatable IFNγ plasmid constructs can have optional Flag, His or other affinity tags, and are electroporated into HEK293 or other suitable human or mammalian cell lines and purified. Validation assays include T cell activation assays using T cells responsive to IFNγ stimulation in the presence of a protease.

15.2 Generation of a scFv CD20 Binding Domain

CD20 is one of the cell surface proteins present on B-lymphocytes. CD20 antigen is found in normal and malignant pre-B and mature B lymphocytes, including those in over 90% of B-cell non-Hodgkin's lymphomas (NHL). The antigen is absent in hematopoietic stem cells, activated B lymphocytes (plasma cells) and normal tissue. As such, several antibodies mostly of murine origin have been described: IFS, 2B8/C2B8, $2H_7$, and $1H_4$.

Human or humanized anti-CD20 antibodies are therefore used to generate scFv sequences for CD20 binding domains of an activatable IFNγ protein. DNA sequences coding for human or humanized VL and VH domains are obtained, and the codons for the constructs are, optionally, optimized for expression in cells from Homo sapiens. The order in which the VL and VH domains appear in the scFv is varied (i.e., VL-VH, or VH-VL orientation), and three copies of the "G4S" (SEQ ID NO: 241) or "G4S" (SEQ ID NO: 241) subunit (G45)3 (SEQ ID NO: 242) connect the variable domains to create the scFv domain. Anti-CD20 scFv plasmid constructs can have optional Flag, His or other affinity tags, and are electroporated into HEK293 or other suitable human or mammalian cell lines and purified. Validation assays include binding analysis by FACS, kinetic analysis using Proteon, and staining of CD20-expressing cells.

15.3 Cloning of DNA Expression Constructs Encoding the Activatable IFNγ Protein

The activatable IFNγ construct with protease cleavage site domains is used to construct an activatable IFNγ protein in combination with an anti-CD20 scFv domain and a serum half-life extension element (e.g., a HSA binding peptide or VH domain). For expression of an activatable IFNγ protein in CHO cells, coding sequences of all protein domains are cloned into a mammalian expression vector system. In brief, gene sequences encoding the activatable IFNγ domain, serum half-life extension element, and CD20 binding domain along with peptide linkers L 1 and L2 are separately synthesized and subcloned. The resulting constructs are then ligated together in the order of CD20 binding domain—L1-IFNγ subunit 1-L2—protease cleavage domain—L3-IFNγ subunit2-L4-anti-CD20 scFv-L5—serum half-life extension element to yield a final construct. All expression constructs are designed to contain coding sequences for an N-terminal signal peptide and a C-terminal hexahistidine (6×His)-tag (SEQ ID NO: 243) to facilitate protein secretion and purification, respectively.

15.4 Expression of activatable IFNγ proteins in stably transfected CHO cells

A CHO cell expression system (Flp-In®, Life Technologies), a derivative of CHO-Kl Chinese Hamster ovary cells (ATCC, CCL-61) (Kao and Puck, Proc. Natl. Acad. Sci. USA 1968; 60(4):1275-81), is used. Adherent cells are subcultured according to standard cell culture protocols provided by Life Technologies.

For adaption to growth in suspension, cells are detached from tissue culture flasks and placed in serum-free medium. Suspension-adapted cells are cryopreserved in medium with 10% DMSO.

Recombinant CHO cell lines stably expressing secreted activatable IFNγ proteins are generated by transfection of suspension-adapted cells. During selection with the antibiotic Hygromycin B viable cell densities are measured twice a week, and cells are centrifuged and resuspended in fresh selection medium at a maximal density of $0.1\times10^6$ viable cells/mL. Cell pools stably expressing activatable IFNγ proteins are recovered after 2-3 weeks of selection at which point cells are transferred to standard culture medium in shake flasks. Expression of recombinant secreted proteins is confirmed by performing protein gel electrophoresis or flow cytometry. Stable cell pools are cryopreserved in DMSO containing medium.

Activatable IFNγ proteins are produced in 10-day fed-batch cultures of stably transfected CHO cell lines by secretion into the cell culture supernatant. Cell culture supernatants are harvested after 10 days at culture viabilities of typically >75%. Samples are collected from the production cultures every other day and cell density and viability are assessed. On day of harvest, cell culture supernatants are cleared by centrifugation and vacuum filtration before further use.

Protein expression titers and product integrity in cell culture supernatants are analyzed by SD S-PAGE.

15.5 Purification of Activatable IFNγ Proteins

Activatable IFNγ proteins are purified from CHO cell culture supernatants in a two-step procedure. The constructs are subjected to affinity chromatography in a first step followed by preparative size exclusion chromatography (SEC) on Superdex 200 in a second step. Samples are buffer-exchanged and concentrated by ultrafiltration to a typical concentration of >1 mg/mL. Purity and homogeneity (typically >90%) of final samples are assessed by SDS PAGE under reducing and non-reducing conditions, followed by immunoblotting using an anti-HSA or anti idiotype antibody as well as by analytical SEC, respectively. Purified proteins are stored at aliquots at −80° C. until use.

Example 16: Determination of Antigen Affinity by Flow Cytometry

The activatable IFNγ proteins are tested for their binding affinities to human CD20+ cells and cynomolgus $CD20^+$ cells.

$CD20^+$ cells are incubated with 100 μL of serial dilutions of the activatable IFNγ proteins and at least one protease. After washing three times with FACS buffer the cells are incubated with 0.1 mL of 10 μg/mL mouse monoclonal anti-idiotype antibody in the same buffer for 45 min on ice. After a second washing cycle, the cells are incubated with 0.1 mL of 15 μg/mL FITC-conjugated goat anti-mouse IgG antibodies under the same conditions as before. As a control, cells are incubated with the anti-His IgG followed by the FITC-conjugated goat anti-mouse IgG antibodies without the activatable IFNγ proteins. The cells were then washed again and resuspended in 0.2 mL of FACS buffer containing 2 μg/mL propidium iodide (PI) in order to exclude dead cells. The fluorescence of $1\times10^4$ living cells is measured using a Beckman-Coulter FC500 MPL flow cytometer using the MXP software (Beckman-Coulter, Krefeld, Germany) or a Millipore Guava EasyCyte flow cytometer using the Incyte software (Merck Millipore, Schwalbach, Germany). Mean fluorescence intensities of the cell samples are calculated using CXP software (Beckman-Coulter, Krefeld, Germany) or Incyte software (Merck Millipore, Schwalbach, Germany). After subtracting the fluorescence intensity values of the cells stained with the secondary and tertiary reagents alone the values are then used for calculation of the $K_D$ values with the equation for one-site binding (hyperbola) of the GraphPad Prism (version 6.00 for Windows, GraphPad Software, La Jolla Calif. USA).

CD20 binding and cross-reactivity are assessed on the human $CD20^+$ tumor cell lines. The $K_D$ ratio of cross-reactivity is calculated using the $K_D$ values determined on the CHO cell lines expressing either recombinant human or recombinant cynomolgus antigens.

Example 17: Cytotoxicity Assay

The activatable IFNγ protein is evaluated in vitro on its mediation of immune response to $CD20^+$ target cells.

Fluorescence labeled $CD20^+$ REC-1 cells (a Mantle cell lymphoma cell line, ATCC CRL-3004) are incubated with isolated PBMC of random donors or CB15 T-cells (standardized T-cell line) as effector cells in the presence of the activatable IFNγ protein and at least one protease.

After incubation for 4 h at 37° C. in a humidified incubator, the release of the fluorescent dye from the target cells into the supernatant is determined in a spectrofluorometer. Target cells incubated without the activatable IFNγ protein and target cells totally lysed by the addition of saponin at the end of the incubation serve as negative and positive controls, respectively.

Based on the measured remaining living target cells, the percentage of specific cell lysis is calculated according to the following formula: [1−(number of living $\text{targets}_{(sample)}$/number of living $\text{targets}_{(spontaneous)}$]×100%. Sigmoidal dose response curves and EC50 values are calculated by non linear regression/4-parameter logistic fit using the GraphPad Software. The lysis values obtained for a given antibody concentration are used to calculate sigmoidal dose-response curves by 4 parameter logistic fit analysis using the Prism software.

Example 18: Pharmacokinetics of Activatable IFNγ Proteins

The activatable IFNγ protein is evaluated for half-time elimination in animal studies.

The activatable IFNγ protein is administered to cynomolgus monkeys as a 0.5 mg/kg bolus injection into the saphenous vein. Another cynomolgus monkey group receives a comparable cytokine in size but lacking a serum half-life extension element. A third and fourth group receive a cytokine with serum half-life extension elements and a cytokine with CD20 and serum half-life extension elements respectively, and both comparable in size to the activatable IFNγ protein. Each test group consists of 5 monkeys. Serum samples are taken at indicated time points, serially diluted, and the concentration of the proteins is determined using a binding ELISA to CD20.

Pharmacokinetic analysis is performed using the test article plasma concentrations. Group mean plasma data for each test article conforms to a multi-exponential profile when plotted against the time post-dosing. The data are fit by a standard two-compartment model with bolus input and first-order rate constants for distribution and elimination phases. The general equation for the best fit of the data for i.v. administration is: $c(t)=Ae^{-\alpha t}+Be^{-\beta t}$, where c(t) is the plasma concentration at time t, A and B are intercepts on the Y-axis, and $\alpha$ and $\beta$ are the apparent first-order rate constants for the distribution and elimination phases, respectively. The $\alpha$-phase is the initial phase of the clearance and reflects distribution of the protein into all extracellular fluid of the animal, whereas the second or $\beta$-phase portion of the decay curve represents true plasma clearance. Methods for fitting such equations are well known in the art. For example, $A=D/V(\alpha-k21)/(\alpha-\beta)$, $B=D/V(\beta-k21)/(\alpha-\beta)$, and $\alpha$ and $\beta$ (for $a>\beta$) are roots of the quadratic equation: $r^2+(k12+k21+k10)r+k21k10=0$ using estimated parameters of V=volume of distribution, k10=elimination rate, k12=transfer rate from compartment 1 to compartment 2 and k21=transfer rate from compartment 2 to compartment 1, and D=the administered dose.

Data analysis: Graphs of concentration versus time profiles are made using KaleidaGraph (KaleidaGraph™ V. 3.09 Copyright 1986-1997. Synergy Software. Reading, Pa.). Values reported as less than reportable (LTR) are not included in the PK analysis and are not represented graphically. Pharmacokinetic parameters are determined by compartmental analysis using WinNonlin software (WinNonlin® Professional V. 3.1 WinNonlin™ Copyright 1998-1999. Pharsight Corporation. Mountain View, Calif.). Pharmacokinetic parameters are computed as described in Ritschel W A and Kearns G L, 1999, IN: *Handbook of Basic Pharmacokinetics Including Clinical Applications*, 5th edition, American Pharmaceutical Assoc., Washington, D.C.

It is expected that the activatable IFNγ protein has improved pharmacokinetic parameters such as an increase in elimination half-time as compared to proteins lacking a serum half-life extension element.

Example 19: Xenograft Tumor Model

The activatable IFNγ protein is evaluated in a xenograft model.

Female immune-deficient NOD/scid mice are sub-lethally irradiated (2 Gy) and subcutaneously inoculated with $4 \times 10^6$ Ramos RA1 cells into the right dorsal flank. When tumors reach 100 to 200 mm³, animals are allocated into 3 treatment groups. Groups 2 and 3 (8 animals each) are intraperitoneally injected with $1.5 \times 10^7$ activated human T-cells. Three days later, animals from Group 3 are subsequently treated with a total of 9 intravenous doses of 50 µg activatable IFNγ protein. Groups 1 and 2 are only treated with vehicle. Body weight and tumor volume are determined for 30 days.

It is expected that animals treated with the activatable IFNγ protein have a statistically significant delay in tumor growth in comparison to the respective vehicle-treated control group.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention.

It is intended that the following claims define the scope of the invention and that methods and structures within the scope of these claims and their equivalents be covered thereby.

Example 20: HEK Blue Assay

HEK-Blue IL12 cells (InvivoGen) were plated in suspension at a concentration of 250,000 cells/well in culture media with or without 40 mg/ml human serum albumin (HSA) and stimulated with a dilution series of recombinant hIL12, chimeric IL12 (mouse p35/human p40) or activatable hIL12 for 24 hours at 37° C. and 5% $CO_2$. Activity of uncleaved and cleaved activatable hIL12 was tested. Cleaved inducible hIL12 was generated by incubation with active MMP9. IL12 activity was assessed by quantification of Secreted Alkaline Phosphatase (SEAP) activity using the reagent QUANTI-Blue (InvivoGen), a colorimetric based assay.

HEK-Blue IL2 cells (InvivoGen) were plated in suspension at a concentration of 50,000 cells/well in culture media with or without 15-40 mg/ml human serum albumin (HSA) and stimulated with a dilution series of recombinant hIL2 or activatable hIL2 for 24 hours at 37° C. and 5% $CO_2$. Activity of uncleaved and cleaved activatable hIL2 was tested. Cleaved inducible hIL2 was generated by incubation with active MMP9 or another protease. IL2 activity was assessed by quantification of Secreted Alkaline Phosphatase (SEAP) activity using the reagent QUANTI-Blue (InvivoGen), a colorimetric based assay. Results are shown in FIGS. 59-62.

Example 21: Splenocyte T-Blast Assay

T-Blasts were induced from murine splenocytes with a 6-day incubation with PHA and a 24 hr incubation with recombinant hIL12. T-blasts were then plated in suspension at a concentration of 200,000 cells/well in culture media with or without 40 mg/ml human serum albumin (HSA) and stimulated with a dilution series of recombinant hIL12 or chimeric IL12 (mouse p35/human p40) or mouse IL12 for 72 hours at 37° C. and 5% $CO_2$. Activity of uncleaved and cleaved IL12 was tested. Cleaved inducible hIL12 was generated by incubation with active MMP9. IL12 activity was assessed by downstream quantification of IFNγ production using a mIFNγ alphaLISA.

Example 22: In Vivo Delivery of a Protease Activated Fusion Protein Results in Decreased Tumor Growth The chimeric polypeptide is examined to determine if it could have biological effects in vivo. For these experiments a system is used in which tumor cells injected intraperitoneally rapidly and preferentially attach and grow initially on the milky spots, a series of organized immune aggregates found on the omentum (Gerber et al., Am. J. Pathol. 169: 1739-52 (2006)). This system offers a convenient way to examine the effects of fusion protein treatment on tumor growth since fusion proteins can be delivered intraperitoneally multiple times and tumor growth can be analyzed by examining the dissociated omental cells. For these experiments, the Colon 38 cell line, a rapidly growing tumor cell line that expresses both MMP2 and MMP9 in vitro, may be used. The omental tissue normally expresses a relatively small amount of MMP2 and MMP9, but, when Colon 38 tumor is present on the omentum, MMP levels increase. Using this tumor model, the ability of IL-2 mutein fusion proteins to affect tumor growth is examined Colon 38 cells are injected intraperitoneally, allowed to attach and grow for 1 day, and then treated daily with fusion protein intraperitoneally. At day 7, the animals are sacrificed and the omenta examined for tumor growth using flow cytometry and by a colony-forming assay.

Example 23A: Construction of an Exemplary Activatable Interleukin Protein TargetingCD20

23.1 Generation of an Activatable Interleukin Domain

The human IL-12p35 chain canonical sequence is UniProt Accession No. P29459. The human IL-12p40 chain canonical sequence is UniProt Accession No. P29460. IL-12p35 and IL-12p40 are cloned into an expression construct. A protease cleavage site is included between the IL-12p35 and IL-12p40 domains. An IL-12 polypeptide capable of binding to CD20 polypeptide present in a tumor or on a tumor cell is produced as follows. A nucleic acid is produced that contains nucleic acid sequences: (1) encoding an IFNγ polypeptide sequence and (2) one or more polypeptide linkers. Activatable interleukin plasmid constructs can have optional Flag, His or other affinity tags, and are electroporated into HEK293 or other suitable human or mammalian cell lines and purified. Validation assays include T cell activation assays using T cells responsive to IL-12 stimulation in the presence of a protease.

23.2 Generation of a scFv CD20 binding domain

CD20 is one of the cell surface proteins present on B-lymphocytes. CD20 antigen is found in normal and malignant pre-B and mature B lymphocytes, including those in over 90% of B-cell non-Hodgkin's lymphomas (NHL). The antigen is absent in hematopoietic stem cells, activated B lymphocytes (plasma cells) and normal tissue. As such, several antibodies mostly of murine origin have been described: IFS, 2B8/C2B8, $2H_7$, and $1H_4$.

Human or humanized anti-CD20 antibodies are therefore used to generate scFv sequences for CD20 binding domains of an activatable interleukin protein. DNA sequences coding for human or humanized VL and VH domains are obtained, and the codons for the constructs are, optionally, optimized for expression in cells from *Homo sapiens*. The order in which the VL and VH domains appear in the scFv is varied (i.e., VL-VH, or VH-VL orientation), and three copies of the "G4S" (SEQ ID NO: 241) or "$G_4S$" (SEQ ID NO: 241) subunit (G45)3 (SEQ ID NO: 242) connect the variable domains to create the scFv domain. Anti-CD20 scFv plasmid constructs can have optional Flag, His or other affinity tags, and are electroporated into HEK293 or other suitable human or mammalian cell lines and purified. Validation assays include binding analysis by FACS, kinetic analysis using Proteon, and staining of CD20-expressing cells.

23.3 Cloning of DNA Expression Constructs Encoding the Activatable Interleukin Protein The activatable interleukin construct with protease cleavage site domains are used to construct an activatable interleukin protein in combination with an anti-CD20 scFv domain and a serum half-life extension element (e.g., a HSA binding peptide or VH domain). For expression of an activatable interleukin protein in CHO cells, coding sequences of all protein domains are cloned into a mammalian expression vector system. In brief, gene sequences encoding the activatable interleukin domain, serum half-life extension element, and CD20 binding domain along with peptide linkers L1 and L2 are separately synthesized and subcloned. The resulting constructs are then ligated together in the order of CD20 binding domain-L1-IL-12p35-L2-protease cleavage domain—L3-IL-12p40-L4-anti-CD20 scFv-L5—serum half-life extension element to yield a final construct. All expression constructs are designed to contain coding sequences for an N-terminal signal peptide and a C-terminal hexahistidine (6×His)-tag (SEQ ID NO: 243) to facilitate protein secretion and purification, respectively.

23.4 Expression of Activatable Interleukin Proteins in Stably Transfected CHO Cells A CHO cell expression system (Flp-In®, Life Technologies), a derivative of CHO-Kl Chinese Hamster ovary cells (ATCC, CCL-61) (Kao and Puck, Proc. Natl. Acad Sci USA 1968; 60(4):1275-81), is used. Adherent cells are subcultured according to standard cell culture protocols provided by Life Technologies.

For adaption to growth in suspension, cells are detached from tissue culture flasks and placed in serum-free medium. Suspension-adapted cells are cryopreserved in medium with 10% DMSO.

Recombinant CHO cell lines stably expressing secreted activatable interleukin proteins are generated by transfection of suspension-adapted cells. During selection with the antibiotic Hygromycin B viable cell densities are measured twice a week, and cells are centrifuged and resuspended in fresh selection medium at a maximal density of $0.1\times10^6$ viable cells/mL. Cell pools stably expressing activatable interleukin proteins are recovered after 2-3 weeks of selection at which point cells are transferred to standard culture medium in shake flasks. Expression of recombinant secreted proteins is confirmed by performing protein gel electrophoresis or flow cytometry. Stable cell pools are cryopreserved in DMSO containing medium.

Activatable interleukin proteins are produced in 10-day fed-batch cultures of stably transfected CHO cell lines by secretion into the cell culture supernatant. Cell culture supernatants are harvested after 10 days at culture viabilities of typically >75%. Samples are collected from the production cultures every other day and cell density and viability are assessed. On day of harvest, cell culture supernatants are cleared by centrifugation and vacuum filtration before further use.

Protein expression titers and product integrity in cell culture supernatants are analyzed by SD S-PAGE.

23.5 Purification of Activatable Interleukin Proteins

Activatable interleukin proteins are purified from CHO cell culture supernatants in a two-step procedure. The constructs are subjected to affinity chromatography in a first step followed by preparative size exclusion chromatography (SEC) on Superdex 200 in a second step. Samples are buffer-exchanged and concentrated by ultrafiltration to a typical concentration of >1 mg/mL. Purity and homogeneity (typically >90%) of final samples are assessed by SDS PAGE under reducing and non-reducing conditions, followed by immunoblotting using an anti-HSA or anti idiotype antibody as well as by analytical SEC, respectively. Purified proteins are stored at aliquots at −80° C. until use.

Example 23B: Determination of Antigen Affinity by Flow Cytometry

Activatable interleukin proteins are tested for their binding affinities to human $CD20^+$ cells and cynomolgus $CD20^+$ cells.

$CD20^+$ cells are incubated with 100 μL of serial dilutions of the activatable interleukin proteins and at least one protease. After washing three times with FACS buffer the cells are incubated with 0.1 mL of 10 μg/mL mouse monoclonal anti-idiotype antibody in the same buffer for 45 min on ice. After a second washing cycle, the cells are incubated with 0.1 mL of 15 μg/mL FITC-conjugated goat anti-mouse IgG antibodies under the same conditions as before. As a control, cells are incubated with the anti-His IgG followed by the FITC-conjugated goat anti-mouse IgG antibodies without the activatable interleukin proteins. The cells were then washed again and resuspended in 0.2 mL of FACS buffer containing 2 µg/mL propidium iodide (PI) in order to exclude dead cells. The fluorescence of 1×10$^4$ living cells is measured using a Beckman-Coulter FC500 MPL flow cytometer using the MXP software (Beckman-Coulter, Krefeld, Germany) or a Millipore Guava EasyCyte flow cytometer using the Incyte software (Merck Millipore, Schwalbach, Germany). Mean fluorescence intensities of the cell samples are calculated using CXP software (Beckman-Coulter, Krefeld, Germany) or Incyte software (Merck Millipore, Schwalbach, Germany). After subtracting the fluorescence intensity values of the cells stained with the secondary and tertiary reagents alone the values are then used for calculation of the $K_D$ values with the equation for one-site binding (hyperbola) of the GraphPad Prism (version 6.00 for Windows, GraphPad Software, La Jolla Calif. USA).

CD20 binding and cross-reactivity are assessed on the human CD20$^+$ tumor cell lines. The $K_D$ ratio of cross-reactivity is calculated using the $K_D$ values determined on the CHO cell lines expressing either recombinant human or recombinant cynomolgus antigens.

Example 24: Cytotoxicity Assay

The activatable interleukin protein is evaluated in vitro on its mediation of immune response to CD20 target cells.

Fluorescence labeled CD20$^+$ REC-1 cells (a Mantle cell lymphoma cell line, ATCC CRL-3004) are incubated with isolated PBMC of random donors or CB15 T-cells (standardized T-cell line) as effector cells in the presence of the activatable interleukin protein and at least one protease. After incubation for 4 h at 37° C. in a humidified incubator, the release of the fluorescent dye from the target cells into the supernatant is determined in a spectrofluorometer. Target cells incubated without the activatable interleukin protein and target cells totally lysed by the addition of saponin at the end of the incubation serve as negative and positive controls, respectively.

Based on the measured remaining living target cells, the percentage of specific cell lysis is calculated according to the following formula: [1−(number of living targets$_{(sample)}$/number of living targets$_{(spontaneous)}$]×100%. Sigmoidal dose response curves and EC50 values are calculated by non linear regression/4-parameter logistic fit using the GraphPad Software. The lysis values obtained for a given antibody concentration are used to calculate sigmoidal dose-response curves by 4 parameter logistic fit analysis using the Prism software.

Example 25: Pharmacokinetics of Activatable Interleukin Proteins

The activatable interleukin protein is evaluated for half-time elimination in animal studies.

The activatable interleukin protein is administered to cynomolgus monkeys as a 0.5 mg/kg bolus injection into the saphenous vein. Another cynomolgus monkey group receives a comparable cytokine in size but lacking a serum half-life extension element. A third and fourth group receive a cytokine with serum half-life extension elements and a cytokine with CD20 and serum half-life extension elements respectively, and both comparable in size to the activatable interleukin protein. Each test group consists of 5 monkeys. Serum samples are taken at indicated time points, serially diluted, and the concentration of the proteins is determined using a binding ELISA to CD20.

Pharmacokinetic analysis is performed using the test article plasma concentrations. Group mean plasma data for each test article conforms to a multi-exponential profile when plotted against the time post-dosing. The data are fit by a standard two-compartment model with bolus input and first-order rate constants for distribution and elimination phases. The general equation for the best fit of the data for i.v. administration is: $c(t)=Ae^{-\alpha t}+ Be^{-\beta t}$, where c(t) is the plasma concentration at time t, A and B are intercepts on the Y-axis, and α and β are the apparent first-order rate constants for the distribution and elimination phases, respectively. The α-phase is the initial phase of the clearance and reflects distribution of the protein into all extracellular fluid of the animal, whereas the second or β-phase portion of the decay curve represents true plasma clearance. Methods for fitting such equations are well known in the art. For example, A=D/V(α-k21)/(α-β), B=D/V(β-k21)/(α-β), and α and β (for a>β) are roots of the quadratic equation: $r^2+(k12+k21+k10)r+k21k10=0$ using estimated parameters of V=volume of distribution, k10=elimination rate, k12=transfer rate from compartment 1 to compartment 2 and k21=transfer rate from compartment 2 to compartment 1, and D=the administered dose.

Data analysis: Graphs of concentration versus time profiles are made using KaleidaGraph (KaleidaGraph™ V. 3.09 Copyright 1986-1997. Synergy Software. Reading, Pa.). Values reported as less than reportable (LTR) are not included in the PK analysis and are not represented graphically. Pharmacokinetic parameters are determined by compartmental analysis using WinNonlin software (WinNonlin® Professional V. 3.1 WinNonlin™ Copyright 1998-1999. Pharsight Corporation. Mountain View, Calif.). Pharmacokinetic parameters are computed as described in Ritschel W A and Kearns G L, 1999, IN: *Handbook of Basic Pharmacokinetics Including Clinical Applications*, 5th edition, American Pharmaceutical Assoc., Washington, D.C.

It is expected that the activatable interleukin protein has improved pharmacokinetic parameters such as an increase in elimination half-time as compared to proteins lacking a serum half-life extension element.

Example 26: Xenograft Tumor Model

Activatable interleukin protein is evaluated in a xenograft model.

Female immune-deficient NOD/scid mice are sub-lethally irradiated (2 Gy) and subcutaneously inoculated with 4×10$^6$ Ramos RA1 cells into the right dorsal flank. When tumors reach 100 to 200 mm$^3$, animals are allocated into 3 treatment groups. Groups 2 and 3 (8 animals each) are intraperitoneally injected with 1.5×10$^7$ activated human T-cells. Three days later, animals from Group 3 are subsequently treated with a total of 9 intravenous doses of 50 µg activatable interleukin protein. Groups 1 and 2 are only treated with vehicle. Body weight and tumor volume are determined for 30 days.

TABLE 3

Summary of the treatment modes

| Gr. | N | Agent | Formulation dose | Route | Schedule |
|---|---|---|---|---|---|
| 1# | 10 | Vehicle | — | ip | biwk × 3 |
| 2 | 7 | ACP16 | 700 µg/animal | ip | biwk × 3 |
| 3 | 7 | ACP16 | 230 µg/animal | ip | biwk × 3 |
| 4 | 7 | ACP16 | 70 µg/animal | ip | biwk × 3 |
| 5 | 7 | ACP16 | 55 ug/animal | ip | biwk × 3 |

TABLE 3-continued

Summary of the treatment modes

| Gr. | N | Agent | Formulation dose | Route | Schedule |
|---|---|---|---|---|---|
| 6 | 7 | ACP16 | 17 μg/animal | ip | biwk × 3 |
| 7 | 7 | ACP132 | 361 μg/animal | ip | biwk × 3 |
| 8 | 7 | ACP132 | 119 μg/animal | ip | biwk × 3 |
| 9 | 7 | ACP132 | 36 μg/animal | ip | biwk × 3 |
| 10 | 7 | ACP132 | 28 μg/animal | ip | biwk × 3 |
| 11 | 7 | ACP132 | 9 μg/animal | ip | biwk × 3 |
| 12 | 7 | ACP21 | 540 μg/animal | ip | biwk × 3 |
| 13 | 7 | ACP21 | 177 μg/animal | ip | biwk × 3 |
| 14 | 7 | ACP21 | 54 μg/animal | ip | biwk × 3 |
| 15 | 7 | ACP21 | 42 μg/animal | ip | biwk × 3 |
| 16 | 7 | ACP21 | 13 μg/animal | ip | biwk × 3 |
| 17 | 7 | ACP133 | 210 μg/animal | ip | bid × 5 then 2-day pause then bid × 5 then 2-day pause |
| 18 | 7 | ACP133 | 105 μg/animal | ip | bid × 5 then 2-day pause then bid × 5 then 2-day pause |
| 19 | 7 | ACP133 | 40 μg/animal | ip | bid × 5 then 2-day pause then bid × 5 then 2-day pause |
| 20 | 7 | ACP133 | 3 μg/animal | ip | bid × 5 then 2-day pause then bid × 5 then 2-day pause |

Control Group

It is expected that animals treated with the activatable interleukin protein have a IDC-29, T1, M statistically significant delay in tumor growth in comparison to the respective vehicle-treated control group.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

The MC38 cell line, a rapidly growing colon adenocarcinoma cell line that expresses MMP9 in vitro, was used. Using this tumor model, the ability of fusion proteins to affect tumor growth was examined.

Example 27A: MC38 IL-2POC 27A.1 Agents and Treatment

Additional studies were carried out in non-tumor bearing animals as described below.

TABLE 4

Summarizes the treatment regime.

| Gr. | N | Agent | Formulation dose | Route | Schedule |
|---|---|---|---|---|---|
| 1 | 8 | Vehicle | — | ip | biwk × 4 |
| 2 | 8 | ACP16 | 700 μg/animal | ip | biwk × 4 |
| 3 | 8 | ACP16 | 230 μg/animal | ip | biwk × 4 |
| 4 | 8 | ACP16 | 70 μg/animal | ip | biwk × 4 |
| 8 | 8 | ACP153 | 700 μg/animal | ip | biwk × 4 |
| 9 | 8 | ACP153 | 230 μg/animal | ip | biwk × 4 |
| 10 | 8 | ACP153 | 70 μg/animal | ip | biwk × 4 |
| 11 | 8 | ACP154 | 700 μg/animal | ip | biwk × 4 |
| 12 | 8 | ACP154 | 230 μg/animal | ip | biwk × 4 |
| 13 | 8 | ACP154 | 70 μg/animal | ip | biwk × 4 |
| 14 | 8 | ACP155 | 700 μg/animal | ip | biwk × 4 |
| 15 | 8 | ACP155 | 230 μg/animal | ip | biwk × 4 |
| 16 | 8 | ACP155 | 70 μg/animal | ip | biwk × 4 |
| 17 | 8 | ACP156 | 700 μg/animal | ip | biwk × 4 |
| 18 | 8 | ACP156 | 230 μg/animal | ip | biwk × 4 |
| 19 | 8 | ACP156 | 70 μg/animal | ip | biwk × 4 |
| 20 | 8 | ACP157 | 700 μg/animal | ip | biwk × 4 |
| 21 | 8 | ACP157 | 230 μg/animal | ip | biwk × 4 |
| 22 | 8 | ACP157 | 70 μg/animal | ip | biwk × 4 |

TABLE 5

Describes the constructs used in the MC38 IL-2POC animal study.

| Construct Name | Description | MW |
|---|---|---|
| ACP16 | IL2-X-HSA-LX-blocker Fusion protein-6xHis | 58256 |
| ACP133 | IL-2 with C term 6x His | 16462 |
| ACP132 | IL2-L-HSA | 29996 |
| ACP21 | IL2-XL-blocker Fusion protein-6xHis | 44843 |

Example 27B: MC38 IL-2

TABLE 6

Summarizes the treatment regime.

| Gr. | N | Agent | Formulation dose | Route | Schedule |
|---|---|---|---|---|---|
| 1# | 12 | Vehicle | — | ip | biwk × 2 |
| 2 | 8 | ACP16 | 4.4 μg/animal | ip | biwk × 2 |
| 3 | 8 | ACP16 | 17 μg/animal | ip | biwk × 2 |
| 4 | 8 | ACP16 | 70 μg/animal | ip | biwk × 2 |
| 5 | 8 | ACP16 | 232 μg/animal | ip | biwk × 2 |
| 6 | 8 | ACP130 | 19 μg/animal | ip | biwk × 2 |
| 7 | 8 | ACP130 | 45 μg/animal | ip | biwk × 2 |
| 8 | 8 | ACP130 | 180 μg/animal | ip | biwk × 2 |
| 9 | 8 | ACP130 | 600 μg/animal | ip | biwk × 2 |
| 12 | 8 | ACP124 | 17 μg/animal | ip | biwk × 2 |
| 13 | 8 | ACP124 | 70 μg/animal | ip | biwk × 2 |
| 14 | 8 | ACP124 | 230 μg/animal | ip | biwk × 2 |
| 15 | 8 | ACP124 | 700 μg/animal | ip | biwk × 2 |
| 16 | 8 | IL-2-WTI | 12 μg/animal | ip | bid × 5 then 2-day pause then bid × 5 then 2-day pause |
| 17 | 8 | IL-2-WTI | 36 μg/animal | ip | bid × 5 then 2-day pause then bid × 5 then 2-day pause |

Control Group 27B.1 Procedure

Mice were anaesthetized with isoflurane for implant of cells to reduce the ulcerations. 308 CR female C57BL/6 mice were set up with 5×105 MC38 tumor cells in 0% Matrigel sc in flank.

Cell Injection Volume was 0.1 mL/mouse. Mouse age at start date was 8 to 12 weeks. Pair matches were performed when tumors reach an average size of 100-150 mm$^3$ and begin treatment. Body weights were taken at initiation and then biweekly to the end. Caliper measurements were taken biweekly to the end. Any adverse reactions were to be reported immediately. Any individual animal with a single observation of >than 30% body weight loss or three consecutive measurements of >25% body weight loss was euthanized Any group with a mean body weight loss of >20% or >10% mortality stopped dosing; the group was not euthanized and recovery is allowed. Within a group with >20% weight loss, individuals hitting the individual body weight loss endpoint were euthanized. If the group treatment related body weight loss is recovered to within 10% of the original weights, dosing resumed at a lower dose or less frequent dosing schedule. Exceptions to non-treatment body weight % recovery were allowed on a case-by-case basis. Endpoint was tumor growth delay (TGD). Animals were monitored individually. The endpoint of the experiment was a tumor volume of 1500 mm3 or 45 days, whichever comes first. Responders were followed longer. When the endpoint was reached, the animals are to be euthanized 27B.2 Dosing Instructions No compounds in salt form were used. The amount needed per week was calculated, aliquoted accordingly, and stored at−20 C. For each week of dosing, one aliquot was thawed, stored at 4 C, and diluted in the required amount with PBS right before each injection. IL-2-WTI required protection from light; pre-formulation stored at −4° C., post-formulation-stored at−20° C. Lyophilized material was reconstituted as directed by instructions, similar to above. ACP16, ACP130, ACP124, and IL-2 WTI were prepared for dosing in PBS. IL-2-WTI indicates Proleukin (aldesleukin) in PBS; the vehicle was PBS.

Dosing volume was 0.2 mL/mouse for IL-2-WTI; 0.3 mL for ACP16, ACP130; 0.5 mL for ACP 124. Do not adjust for body weight.

27B.3 Special Instructions

ACP16: current amount of required compound–13.45 mg

ACP130: current amount of required compound –25.83 mg

ACP124: current amount of required compound –42.31 mg

IL-2-WTI: current amount of required compound–9.98 mg

Necropsy was to be performed in case of unexpected toxicity

Example 27C: MC38 IFNα and IL-12

27C.1 Agents and Treatment:

TABLE 7

Summarizes the treatment regime.

| Gr. | N | Agent | Formulation dose | Route | Schedule |
|---|---|---|---|---|---|
| 1[#] | 12 | Vehicle | — | ip | biwk × 3 |
| 2 | 8 | ACP11 | 17.5 µg/animal | ip | biwk × 3 |
| 3 | 8 | ACP11 | 175 µg/animal | ip | biwk × 3 |
| 4 | 8 | ACP11 | 525 µg/animal | ip | biwk × 3 |
| 5 | 8 | ACP31 | 33 µg/animal | ip | biwk × 3 |
| 6 | 8 | ACP31 | 110 µg/animal | ip | biwk × 3 |
| 7 | 8 | ACP31 | 330 µg/animal | ip | biwk × 3 |
| 8 | 8 | ACP131 | 1 µg/animal | ip | bid × 5 then 2-day pause then bid × 5 then 2-day pause |
| 9 | 8 | ACP131 | 10 µg/animal | ip | bid × 5 then 2-day pause then bid × 5 then 2-day pause |
| 10 | 8 | ACP131 | 30 µg/animal | ip | bid × 5 then 2-day pause then bid × 5 then 2-day pause |
| 11 | 8 | mIFNa1-WTI | 1 µg/animal | ip | bid × 5 then 2-day pause then bid × 5 then 2-day pause |
| 12 | 8 | mIFNa1-WTI | 10 µg/animal | ip | bid × 5 then 2-day pause then bid × 5 then 2-day pause |
| 13 | 8 | IL-12-HM-WTI | 2 µg/animal | ip | bid × 5 then 2-day pause then bid × 5 then 2-day pause |
| 14 | 8 | IL-12-HM-WTI | 10 µg/animal | ip | bid × 5 then 2-day pause then bid × 5 then 2-day pause |
| 15 | 8 | ACP131 | 5 µg/animal | itu | bid × 5 then 2-day pause then bid × 5 then 2-day pause |

[#]Control Group 27C.2 Procedures

Mice were anaesthetized with isoflurane for implant of cells to reduce the ulcerations. 308 CR female C57BL/6 mice were set up with 5×10⁵ MC38 tumor cells in 0% Matrigel sc in flank. Cell Injection Volume was 0.1 mL/mouse. Mouse age at start date was 8 to 12 weeks. Pair matches were performed when tumors reach an average size of 100-150 mm³ and begin treatment. Body weights were taken at initiation and then biweekly to the end. Caliper measurements were taken biweekly to the end. Any adverse reactions were to be reported immediately. Any individual animal with a single observation of >than 30% body weight loss or three consecutive measurements of >25% body weight loss was euthanized Any group with a mean body weight loss of >20% or >10% mortality stopped dosing; the group was not euthanized and recovery is allowed. Within a group with >20% weight loss, individuals hitting the individual body weight loss endpoint were euthanized. If the group treatment related body weight loss is recovered to within 10% of the original weights, dosing resumed at a lower dose or less frequent dosing schedule. Exceptions to non-treatment body weight % recovery were allowed on a case-by-case basis. Endpoint was tumor growth delay (TGD). Animals were monitored individually. The endpoint of the experiment was a tumor volume of 1500 mm³ or 45 days, whichever comes first. Responders were followed longer. When the endpoint was reached, the animals are to be euthanized 27C.3 Dosing Instructions No compounds in salt form were used. Prepared dosing solutions were as follows: IL-12-HM-WTI was stored to provide protection from light; pre-formulation at−4° C., post-formulation at −20° C. mIFNαl-WTI was stored at −20° C., protected from light; pre-formulation stored at −20° C., post-formulation stored at−4° C. Lyophilized material was reconstituted as directed in instructions. The amount needed per week was calculated, aliquoted accordingly, and stored at −20 C. For each week of dosing, one aliquot was thawed and stored at 4 C, the required amount was diluted with PBS right before each injection.

For ACP11, ACP31, ACP131, the amount needed per week was calculated, aliquoted accordingly, and stored at −20 C. For each week of dosing, one aliquot was thawed and stored at 4 C, the required amount was diluted with PBS right before each injection.

PBS was used as the vehicle for all tests.

Intraperitoneal (ip) dosing volume ACP131, mIFNαl-WTI, IL-12-HM-WTI=0.2 mL/mouse. Dosing volume for ACP11=0.4 mL (before Day 18, 2/26/19) and 0.55 mL (starting on Day 18, 2/26/19).

Dosing volume for ACP31=0.3 mL. Dosage was not adjusted for body weight.

Intratumoral (itu) dosing volume for Gr.16 mIFNαl-WTI and Gr.17 ACP131=0.05 mL/mouse. Dosage was not adjusted for body weight.

Example 27D: MC38 Rechallenge 27D.1 Agents and Treatment:

TABLE 8

Summarizes the treatment regime.

| Gr. | N | Agent | Formulation dose | Route | Schedule |
|---|---|---|---|---|---|
| 1# | 33 | No Treatment | — | — | — |
| 2 | 7 | ACP16 | 70 µg/animal | ip | MC38-e415 Gr 4 An 1-4, 6-8 (ACP16 biwkx2) |
| 3 | 8 | ACP16 | 232 µg/animal | ip | MC38-e415 Gr 5 An 1-8 (ACP16 biwkx2) |
| 5 | 5 | IL-2-WTI | 12 µg/animal | ip | MC38-e415 Gr 16 An 1,3-6 (IL-2-WTI bid × 5 then 2-day pause then bid × 5 then 2-day pause) |
| 6 | 7 | IL-2-WTI | 36 µg/animal | ip | MC38-e415 Gr 17 An 1-7 (IL-2-WTI bid × 5 then 2-day pause then bid × 5 then 2-day pause) |

Control Group 27D.2 Procedures

Mice were anaesthetized with isoflurane for implant of cells to reduce the ulcerations. This portion of the study began on the day of implant (Day 1). Group 1 consisted of 33 CR female C57BL/6 mice set up with 5×105 MC38 tumor cells in 0% Matrigel subcutaneously in the flank. Groups 2-6 consisted of 33 CR female C57BL/6 mice set up with 5×105 MC38 tumor cells in 0% Matrigel sc in the left flank. The tumors from the previous MC38 experiment (example 25×) were implanted in the right flank of each animal Cell Injection Volume was 0.1 mL/mouse. Age of control mice at initiation was 14 to 17 weeks. These mice were age matched to mice from the previous MC38 experiment (example 25×). No dosing of active agent occurred during rechallenge. Body Weights were taken biweekly until end, as were caliper measurements. Any adverse reactions or death were reported immediately. Any individual animal with a single observation of >than 30% body weight loss or three consecutive measurements of >25% body weight loss was euthanized Endpoint was tumor growth delay (TGD). Animals were monitored individually. The endpoint of the experiment was a tumor volume of 1000 mm3 or 45 days, whichever comes first. Responders were followed longer when possible. When the endpoint is reached, the animals were euthanized Example 27E: Treatment with ACP16, APC153, ACP155, and ACP156 (see FIG. 58)

27E.1 Agents and Treatment:

TABLE 9

Summarizes the treatment regime.

| Gr. | N | Agent | Formulation dose | Route | Schedule |
|---|---|---|---|---|---|
| 1# | 12 | Vehicle | — | ip | biwk × 2 |
| 2 | 8 | ACP16 | 17 µg/animal | ip | biwk × 2 |
| 3 | 8 | ACP16 | 55 µg/animal | ip | biwk × 2 |
| 4 | 8 | ACP16 | 230 µg/animal | ip | biwk × 2 |
| 5 | 8 | ACP155 | 55 µg/animal | ip | biwk × 2 |
| 6 | 8 | ACP155 | 230 µg/animal | ip | biwk × 2 |
| 7 | 8 | ACP153 | 55 µg/animal | ip | biwk × 2 |
| 8 | 8 | ACP153 | 230 µg/animal | ip | biwk × 2 |
| 9 | 8 | ACP156 | 55 µg/animal | ip | biwk × 2 |
| 10 | 8 | ACP156 | 230 µg/animal | ip | biwk × 2 |

27E.2 Procedures:

Mice were anaesthetized with isoflurane for implant of cells to reduce the ulcerations. CR female C57BL/6 mice were set up with $5\times10^5$ MC38 tumor cells in 0% Matrigel sc in flank. Cell Injection Volume was 0.1 mL/mouse. Mouse age at start date was 8 to 12 weeks. Pair matches were performed when tumors reach an average size of 100-150 $mm^3$ and begin treatment. ACP16 was dosed at 17, 55 or 230 µg/animal; ACP153, ACP155 and ACP156 were dosed at 55 or 230 µg/animal Body weights were taken at initiation and then biweekly to the end. Caliper measurements were taken biweekly to the end. Any adverse reactions were to be reported immediately. Any individual animal with a single observation of >than 30% body weight loss or three consecutive measurements of >25% body weight loss was euthanized Any group with a mean body weight loss of >20% or >10% mortality stopped dosing; the group was not euthanized and recovery is allowed. Within a group with >20% weight loss, individuals hitting the individual body weight loss endpoint were euthanized. If the group treatment related body weight loss is IDC-35, T1 recovered to within 10% of the original weights, dosing resumed at a lower dose or less frequent dosing schedule. Exceptions to non-treatment body weight % recovery were allowed on a case-by-case basis. Endpoint was tumor growth delay (TGD). Animals were monitored individually. The endpoint of the experiment was a tumor volume of 1500 $mm^3$ or 45 days, whichever comes first. Responders were followed longer. When the endpoint was reached, the animals are to be euthanized Results are shown in FIG. 58A-58D.

Example 28: FRET Screens of Conditioned Media

Proteolytic activity was screened in the conditioned media samples by fluorescent resonance energy transfer (FRET) assays with the substrates listed in Table 10.

TABLE 10

Substrate motif sequences.

| Substrate Name | P4-P4' Sequence | SEQ ID NO: | Experimentally Tested | | |
|---|---|---|---|---|---|
| | | | in vitro kinetics | Conditioned media | 30-mer MSP-MS |
| MMP14_1 | GPAGLYAQ | 195 | ✓ | ✓ | ✓ |
| MMP9_1 | GPAGMKGL | 196 | ✓ | ✓ | — |
| FAPα_1 | PGGPAGIG | 197 | ✓ | ✓ | ✓ |
| CTSL1_1 | ALFKSSFP | 198 | ✓ | ✓ | ✓ |
| CTSL1_2 | ALFFSSPP | 199 | ✓ | ✓ | ✓ |
| ADAM17_1 | LAQRLRSS | 200 | ✓ | ✓ | ✓ |
| ADAM17_2 | LAQKLKSS | 201 | ✓ | ✓ | ✓ |

28.1 Reaction Conditions

Protease specificity screening was performed using Multiplexed Substrate Profiling by Mass Spectrometry (MSP-MS), the method described in, e.g. O'Donoghue A. J. et al., *Nat Methods.*, 2012; 9(11): 1095-1100. This method employs a physico-chemically diverse peptide library as substrates for proteases, and reactions are monitored over time with mass spectrometric detection of cleaved products. The resulting cleavages are assessed for specific cleavage in the enzyme-treated sample by comparison with results from a no-enzyme control incubation.

Sequence logos for motif analysis are generated with iceLogo software (v.1.2) (iomics.ugent.be/icelogoserver/).

Recombinant human enzymes were sourced from R&D Systems (Bio-techne): CTSL1 (#952-CY), ADAM17 (a.k.a. TACE, TNF-alpha Converting Enzyme) (#930-ADB), FAP-alpha (#930-ADB-010), MMP-14 (#918-MP-010), furin (#1503-SE-010), MMP-9 (#911-MP-010), thrombin (#2196-SE-200), thermolysin (#3097-ZN), Factor Xa (#1063-SE-010), hepsin (#4776-SE) and ADAM-TS1 (#2197-AD). Enzymes were activated and assayed following the manufacturer's recommendations.

For CTSL1, enzyme was activated by pre-incubation in assay buffer (50 mM MES, 5 mM DTT, 1 mM EDTA, pH=6) for 15 min. MSP-MS reactions were then started with the mixing of enzyme and substrate, at final CTSL1 concentration of 0.04 ng/μl (0.77 nM), and peptide substrate concentration at 500 nM.

ADAM17 activity was monitored following manufacturer's recommended conditions using the FRET substrate Mca-PLAQAV-Dpa-RSSSR—NH$_2$ (SEQ ID NO: 244), in the recommended assay buffer: 25 mM TRIS, 2.5 μM ZnCl$_2$ at the optimal pH 9.0, and also at physiological pH 7.4. ADAM17 enzyme specificity was profiled in the MSP-MS experiment at pH 9.0 using 10 nM enzyme, and at pH 7.4 using 50 nM enzyme.

MMP-14 was activated following manufacturer's recommended conditions by pre-incubation with the enzyme furin, at a molar ratio of 1:100 furin to MMP-14, at 37° C. and pH 9.0 for 1.5 hours. FRET assays were performed using 20 nM MMP-14 at 37° C. in activation buffer: 50 mM TRIS HCl, 3 mM CaCl$_2$, 104 ZnCl$_2$ at pH 8.5.

MMP9 was activated by incubation with 1 mM p-amino phenyl mercuric acetate (prepared from a stock at 100 mM in DMSO) for 24h at 37° C. in activation buffer: 50 mM TRIS HCl (pH 7.5), 10 mM CaCl$_2$, 150 mM NaCl, 0.05% Brij35. The final enzyme concentration used for fluorescence assays was 2.5 nM.

FAPα activity was tested with fluorescence detection using a generic Z-GP-AMC substrate. For FRET assays, the final enzyme concentration was 5 nM and the buffer was 50 mM TRIS HCl, 1 M NaCl, 1 mg/mL BSA, pH 7.5.

Thrombin was activated following the manufacturer's recommended conditions by pre-incubation with the enzyme with thermolysin for 15 min, and then the thermolysin was quenched with 1,10 phenanthroline treatment. Activated thrombin was assayed at 1.2 nM in activation buffer: 50 mM TRIS HCl, 10 mM CaCl$_2$, 150 mM NaCl, 0.05% (w/v) Brij-35, pH 7.5.

Factor Xa was assayed at 4.7 nM enzyme, at 37° C. in the manufacturer recommended buffer: 50 mM TRIS, 10 mM CaCl$_2$, 150 mM NaCl, pH 7.5.

Hepsin was pre-activated overnight at 37° C. in the manufacturer recommended buffer: 100 mM TRIS, 10 mM CaCl$_2$, 150 mM NaCl, 0.05% Brij-35, pH 8.0. Activity was measured with 2.4 or 24 nM enzyme in the buffer: 50 mM TRIS HCl at pH 7.4.

ADAM-TS1 was assayed at 5 μM enzyme concentration in the manufacturer recommended buffer: 50 mM TRIS, 10 mM CaCl2, 150 mM NaCl at pH 7.5.

28.2 Samples

Conditioned media and cell lysate samples were received from Charles River Laboratories for the murine colon cancer cell lines: MC38 (epithelial), CT26 (fibroblast), and CT26 transduced with a lentivirus for doxycyclin-inducible expression of MMP9 (CT26 pLVX MMP9-5T4+dox). An immortalized mouse intestinal myofibroblast cell line (ABM Good #T0565) was used as a control stromal cell line, grown under manufacturer recommended conditions. Conditioned media and cell lysate samples were also received for screening purposes from ABM Good for the immortalized mouse colonic epithelial cell line YAMC (ABM Good #T0567).

Conditioned media samples were prepared according to the standard protocol using logarithmic phase cells. Briefly, cells were grown for 16h in either serum-free media or in complete media containing 10% fetal bovine serum (FBS). After conditioned media collection, the adherent cells were washed then lysed on plate with non-denaturing lysis buffer to produce a lysed "cell pellet" to capture any activity that remained associated with the cells. All cell culture-derived conditioned media samples, cell lysates from Charles River Laboratories, and cell lysates derived internally were processed with identical methods, to allow comparison between samples.

The resulting conditioned media was buffer exchanged with PBS and concentrated to 10× the original titer as a stock solution.

28.3 Results

Method development experiments with these samples showed that conditioned media containing fetal bovine serum (FBS) were amenable to FRET screening, although a small amount of background fluorescence for each substrate was obtained in the presence of FBS. FBS background controls were therefore used for baseline subtraction at each concentration of substrate throughout the FRET experiments.

In the end-point screening assays, a fixed titer of 10× concentrated sample and a substrate concentration of 10 μM was used. Values reported in the end-point experiments are initial velocity measurements, in relative fluorescence units (RFU) per second. End-point measurements are a starting point for a screen, but the rate of the reaction is non-linearly related to substrate concentration. Therefore, a more accurate representation of activity would be given by steady-state kinetic measurements covering a range of substrate concentrations. To compare activity across cell lines, the data were treated with a Michaelis-Menten model, and the concentration of equivalent enzyme units [E$_0$] was solved.

Accordingly, initial velocity was measured as a function of substrate concentration, using a 2-fold dilution series from 250 to 1 μM. Data were fitted using non-linear least squares fitting with GraphPad Prism software v 8.0 to the Michaelis-Menten equation:

$$\text{velocity} = \frac{k_{cat} \cdot [E_0] \cdot [S]}{(K_M + [S])}$$

where k$_{cat}$ is the rate of product formation under steady-state conditions in units (s$^{-1}$), and K$_M$ is the Michaelis constant that gives the substrate concentration in molar units (M) at which half maximum velocity of the reaction is produced for a given enzyme, [E$_0$] is the enzyme concentration, and [S] the substrate concentration in (M).

In the assays where purified recombinant enzyme is used, the Michaelis-Menten parameters are as classically defined above. For conditioned media samples, the effective titer of conditioned media per assay was adjusted to approximately a 2× concentrate of the original unprocessed media samples to assure that the detection range matched the signal produced. The enzyme component in the calculation is redefined as a mixture of possible proteases that contribute to the cumulative observed activity, each with intrinsic reactivity toward a substrate. In this case, it is more appropriate to consider k$_{cat}$ and K$_M$ as macroscopic constants that represent the overall efficiency of catalysis, and E$_0$ is an enzyme equivalent, expressed in units of concentration. To solve the data fit, k$_{cat}$/KM can be fixed at that of the recombinant enzyme and enzyme equivalents per cell culture volume can be output. The effective titer of enzyme equivalents in this case can be used to compare the activity produced by the different cell lines.

The ratios of enzyme equivalents between tumor and control cell lines may be a contributing factor to therapeutic index in a pro-drug employing protease-cleavable linkers.

For all six motif substrates, greater activity was detected in the conditioned media from the tumor cell lines than from the control myofibroblast cell line (FIG. 36).

The ADAM17 substrate with the sequence LAQKLKSS (ADAM17_2) (SEQ ID NO: 201), based on the results in the end-point screen experiments, had approximately 3-fold greater activity in the conditioned media produced from the three tumor cell lines, compared to the myofibroblast cell line (FIG. 36, black bars). For reference, the activity of recombinant ADAM17 at 12 nM is shown in the same assay format. The steady state kinetic curves for ADAM17 substrate are shown in FIG. 37. There was essentially undetectable ADAM17_2 background activity in the myofibroblast sample.

The CTSL1 substrate, ALFKSSFP (SEQ ID NO: 198) (CTSL1_1), based on the results in the end-point screen experiments, had undetectable activity in the control myofibroblast cell line, as well had low activity in the MC38 and CT26 parental cell lines, and had undetectable activity in the CT26-MMP9+ cell line (FIG. 36). This assay was benchmarked with CTSL1 at 1.5 nM, showing that the extracellular concentration of secreted CTSL1 activity was below this effective concentration across the four cell lines. Re-analysis of conditioned media with the CTSL1_1 substrate using the steady-state kinetics analysis yielded no measurable activity above background.

The secreted activity for FAPα, based on the results in the end-point screen experiments, was very low, but was still detected in all three tumor cell lines (FIG. 36, blue bars). The FAPα_1 activity was benchmarked with 5 nM FAPα enzyme. This enzyme is also found in a plasma membrane-associated form, therefore FAPa activity was also tested in the cell pellet fraction that was collected after the media conditioning procedure. These results will be discussed below.

As observed in the end-point screen, re-analysis of the conditioned media for activity toward the FAPα_1 substrate showed lower activity than that associated with the cell pellet, measured in cell lysates (FIG. 38 and FIG. 39). Myofibroblasts had no measurable secreted activity but did have cell-associated activity (FIG. 38 and FIG. 39).

The MMP substrates MMP9_1 and MMP14_1 all had high activity in the end point screen, and the activity was significantly higher in the tumor cell lines than in the myofibroblast control cells. MMP9_1 (second column from right, FIG. 38) had approximately 4-fold greater activity in the tumor lines than the myofibroblast control; and MMP14_1 had approximately 57-fold greater activity in the tumor lines. The MMP14_1 substrate had the lowest activity in the myofibroblast cells, thus contributing to the higher ratio of tumor vs control in this assay. Secreted activity was measured for the MMP9_1 substrate in the conditioned media for each of the tumor cell lines using the steady-state kinetics analysis (FIG. 36). The myofibroblast cell line had an artefact in analysis of MMP9_1 secreted activity (FIG. 36); this will be addressed with a repeat analysis at higher enzyme titer. As with the MMP9 substrates, the MMP14_1 substrate had significant measurable activity in the conditioned media from the tumor cells but not in the myofibroblast cell line.

Taken together, the results of the FRET screens of conditioned media demonstrated tumor-specific activity for the enzymes ADAM17, CTSL1, MMP9 and MMP14. Soluble FAP-alpha activity was low.

Example 29: Tumor-Specific Activity Toward the FAPa Substrate in the Cell Lysates To test for cell pellet-associated FAPa activity, the cell lysates were clarified by ultracentrifugation and then assayed neat in the FRET assay. As shown in FIG. 41, FAPα_1 cleavage activity was detected in all four cell lines (blue bars, right hand bar of each pair). A modest 2-fold greater activity was detected in the three tumor cell lines over the myofibroblast cell line. For comparison, CTSL1 activity was also tested in the cell lysates. CTSL1 is a lysosomal enzyme; therefore, activity toward CTSL1_1 was expected to be similarly abundant in all four cell lines. The ratio of CTSL1_1 cleavage in tumor vs control cell lines in this screening format was ~1× (grey bars, left-hand bar of each pair, FIG. 41). FAPα (fibroblast activating protein-alpha) is a marker for fibroblast (CT26) and myofibroblast cell lines. Therefore, an additional non-fibroblast, epithelial cell line was obtained as an alternate negative control cell line, comparable to the MC38 epithelial cell line.

Example 30: Cell-Associated Activity Toward CTSL1 Substrate

Cell-associated activity toward CTSL1 substrate was detected in all of the cell lysates, indicating cell-associated activity for this enzyme. The activity was significantly greater in MC38 cells over the myofibroblast, CT26 parental, and CT26-MMP9+ cells (FIG. 42).

Example 31: Secreted Activity in Conditioned Media from Immortalized Myofibroblast Cell Line Low background-corrected fluorescence was observed in all the myofibroblast reactions. Thus, it can be concluded that the immortalized myofibroblast cell line had low conditioned media activity.

Example 32: Screening of an Additional Control "Normal" Epithelial Cell Line

An immortalized mouse colonic epithelial cell line (YAMC) was used to test activity in the presence of additional control "normal" epithelial cells. YAMC's are given the calculated enzyme equivalents (nM) resulting from all of these steady state experiments, to allow for comparison of the amount of equivalent activity per sample. For example, the YAMC control epithelial cell line produced activity with the ADAM17_2 substrate equivalent to that of 0.52±0.03 nM of ADAM17 recombinant enzyme. This cell line compares directly to MC38, also of epithelial origin, which had activity equivalent to that of 0.32±0.03 nM of ADAM17 recombinant enzyme. The results of the screening show that the YAMC cell line generally had more background activity than did the myofibroblast cell line with all of the substrates. This cell line required non-standard cell culture conditions, including growth with murine IFNγ, and at low temperature to maintain, and may not be fully representative of epithelial cell lines.

Example 33: Cleavage of CTSL1_2 Motif in the Context of an 8-Mer FRET Peptide and in the Context of an Extended Tandem Linker Additional in vitro kinetic experiments were performed to characterize a new candidate motif for CTSL1 enzyme; the CTSL1_2 motif has the sequence ALFFSSPP (SEQ ID NO: 199). CTSL1 cleaves the FRET substrate bearing the CTSL1_1 motif highly efficiently (FIG. 46). Yet, initial experiments with the CTSL1_2 FRET substrate were inconclusive, possibly due to artifacts in the FRET assay; therefore, a new FRET peptide construct was designed with the 9-mer sequence ALFFSSPPS (SEQ ID NO: 236). This 9-mer FRET substrate bearing the CTSL1_2 motif produced comparable catalytic efficiency to the CTSL1_1 motif.

All of the FRET substrates used in these studies have a methoxycoumarin (Mca) fluorophore and dinitrophenyl-lysyl (Dnp) quencher pair at the N- and C-termini of the sequences, respectively. The motif ALFFSSPP (SEQ ID NO: 199) was efficiently cleaved in previous experiments at ALFF1SSPP (SEQ ID NO: 199) (where indicates the scissile bond) within 14-mer peptide constructs that were used in the MSP-MS tailored library assay. It was cleaved also at the ALF|FSSPP (SEQ ID NO: 199) and ALFFS|SPP (SEQ ID NO: 199) sites within 14-mer peptides, indicating that the enzyme recognition in the CTSL1_2 motif may be shifted up- or down-sequence by +/−1 site in the 14-mer peptide experiments. This also suggests that the 8-mer design using Mca-ALFFSSPPK-Dnp (SEQ ID NO: 245) may have unfavorable interactions (steric or otherwise) with the fluor/quencher pair in the shifted P4 or P4' positions that were alleviated by the redesign as a 9-mer substrate using Mca-ALFFSSPPSK-Dnp (SEQ ID NO: 246). This FRET experiment indicated that cleavage of this sequence most likely requires binding recognition at the +/−1 positionally-shifted site and that the fluor or quencher may interfere with this binding.

This hypothesis was tested in the context of the hybrid linker design experiment. Shown in FIG. 46 are the results of cleavage of two matched 30-mer peptides with the following sequences:

(CTSL1_1)
(SEQ ID NO: 207)
SGGPGGPAGIGALFKSSFPLAQKLKSSGGG (CTSL1_2)
(SEQ ID NO: 219)
KSGPGGPAGIGALFFSSPPLAQKLKSSGGR

Both peptides showed rapid disappearance of substrate (squares) and product formation from cleavage at the target scissile bond (site 0, blue triangles, FIG. 46). Where the peptides differed is in the permissive cleavage at the −1 and +1 sites. CTSL1_1 had a −1 site product at ALF|KSSFP (SEQ ID NO: 198) (downward triangles) but CTSL1_2 did not, and the +1 site product was more rapidly formed from the CTSL1_2 substrate (ALFFS|SPP (SEQ ID NO: 199)) than with the CTSL1_1 substrate (ALFKS|SFP) (SEQ ID NO: 198).

Counter-screening of CTSL1_1 and CTSL1_2 was performed with the enzyme Cathepsin K (CTSK). The substrate CTSL1_2, although lacking a basic P1 residue (ALFFSSPP (SEQ ID NO: 199)) was measurably cleaved by CTSK but at a 15× lower level than the CTSL1_1 substrate (ALFKSSFP (SEQ ID NO: 198)) FIG. 47. For comparison, the specific activity for reference substrates such as Z-LR-AMC and Z-FR-AMC is 15,000-25,000 pmol/min/µg, with the average value indicated by a dashed line in FIG. 47.

Thus, these results show that the new CTSL1_2 motif was not cleaved in the context of an 8-mer FRET peptide, but it was cleaved as a 9-mer FRET peptide and it was rapidly cleaved in the context of an extended tandem linker.

Example 34: Tandem Linker Analysis with Mass Spectrometric Detection

34.1 Substrate Profiling by Mass Spectrometry

To analyze the catalytic efficiency of candidate tandem linker designs, a tailored library approach using MSP-MS was applied. For the tailored library, a set of nineteen synthetic peptides, 30 amino acids in length (30-mers), were designed to test whether sequence context affects the efficiency of cleavage. Peptides were assayed in a multiplex format together as a substrate library with individual recombinant enzymes, using MSP-MS. For quantitative comparisons, kinetic analysis was performed over a time course, and results are reported either as a catalytic efficiency $k_{cat}/K_M$ for well-behaved first-order kinetics, or as observed rates as $k_{obs}$ for more complex kinetic behavior.

34.2 The Library of Tandem Linker Sequences

The library of tandem linker sequences was designed to incorporate three individual protease motifs within the context of a longer, 30-mer peptide sequence. Table 11 lists the sequences and motif arrangement of the 30-mer peptides.

TABLE 11

30-mer peptide sequences.

| Substrate Name | Sequence | SEQ ID NO: |
|---|---|---|
| ALU30-1 | GALFKSSFPSGGGPAGLYAQGGSGKGGSGK | 202 |
| ALU30-2 | RGSGGGPAGLYAQGSGGGPAGLYAQGGSGK | 203 |
| ALU30-3 | KGGGPAGLYAQGPAGLYAQGPAGLYAQGSR | 204 |
| ALU30-4 | RGGPAGLYAQGGPAGLYAQGGGPAGLYAQK | 205 |
| ALU30-5 | KGGALFKSSFPGGPAGIG GGS | 206 |
| ALU30-6 | SGGPGGPAGIGALFKSSFPLAQKLKSSGGG | 207 |
| ALU30-7 | RGPLAQKLKSSALFKSSFPGGPAGIGGGGK | 208 |
| ALU30-8 | GGGALFKSSFPLAQKLKSSPGGPAGIGGGR | 209 |
| ALU30-9 | RGPGGPAGIGPLAQKLKSSALFKSSFPGGG | 210 |
| ALU30-10 | RGGPLAQKLKSSPGGPAGIGALFKSSFPGK | 211 |
| ALU30-11 | RSGGPAGLYAQALFKSSFPLAQKLKSSGGG | 212 |
| ALU30-12 | GGPLAQKLKSSALFKSSFPGPAGLYAQGGR | 213 |
| ALU30-13 | GGALFKSSFPGPAGLYAQPLAQKLKSSGGK | 214 |
| ALU30-14 | RGGALFKSSFP GPAGLYAQGGK | 215 |
| ALU30-15 | RGGGPAGLYAQ ALFKSSFPGG | 216 |
| ALU30-16 | SGPLAQKLKSSGPAGLYAQALFKSSFPGSK | 217 |
| ALU30-17 | KGGPGGPAGIGPLAQRLRSSALFKSSFPGR | 218 |
| ALU30-18 | KSGPGGPAGIGALFFSSPPLAQKLKSSGGR | 219 |
| ALU30-19 | SGGFPRSGGSFNPRTFGSKRKRRGSRGGGG | 220 |

To test for additive effects of having one, two, or three repeat MMP14_1 motifs with small differences in spacing between the motifs, a set of four tandem linkers were designed (ALU30-1 to -4).

To test whether neighboring effects from adjacent sites could alter the catalytic efficiency of a given protease toward its target motif, the three motifs in a set were arranged in all permutations. For example, the combination of motifs A, B, and C could be arranged as: A-B-C, C-A-B, B-C-A, B-A-C, A-C-B, and C-B-A. These permutations were tested for the tandem combinations of MMP14_1, ADAM17_2, and CTSL1_I as a broad set of motifs susceptible to matrix metalloprotease (MMP) activity (ALU30-11 to -16), and for FAPa 1 with ADAM17_2, and CTSL1_1 as a set with lower MMP sensitivity (ALU30-5 to -10).

Also tested within the library were two alternate substrates for ADAM17 and CTSL1. Two additional peptides were designed, swapping the ADAM17_2 motif with ADAM17_1 (in ALU30-17), or CTSL1_1 with CTSL1_2 (in ALU30-18), demonstrating a strategy for testing further tandem linker designs with new individual protease motifs.

34.3 Counter-Screening

Counter-screening was performed against the enzymes Thrombin, Factor Xa and Hepsin using this library as well, and for calibration of activity, a positive-control peptide bearing favorable motifs for these enzymes was also designed (ALU30-19).

Outside of these motifs, minor variations were made to the bracketing sequences at the N or C-terminus of each tandem linker peptide to generate unique sequences that allow for differentiation of peptides using mass spectrometric detection.

Catalytic efficiency ($k_{cat}/K_M$) estimations were used to rank the top cleaved substrates in the MSP-MS reaction. Peptides were quantified by mass spectrometric label-free quantitation from the MS1 precursor ion peak areas for each peptide. Enzyme progress curves were modeled from six-time point measurements in GraphPad Prism. Data were fitted using non-linear least squares fitting to the first order kinetics equation:

$$Y = e^{\left(-\frac{k_{cat}}{K_M} \cdot [E_0] \cdot t\right)}$$

where Y=percent product formation or substrate consumption, and t=time. The observed rate is a function of the enzyme concentration $[E_0]$, and an observed catalytic efficiency ($k_{cat}/K_M$) in units $M^{-1}s^{-1}$

34.4 Results

Analyses with the 30-mer tandem linker library showed specific cleavages with each of the recombinant enzymes. In this experiment, the rates of substrate degradation and of product formation were both useful comparisons for understanding the efficiency of linker cleavage.

For example, the substrate degradation traces for the 30-mer library peptides are shown from MMP9-treatment in FIG. 55. The most efficient MMP9 substrates were those that bore three-repeats of the MMP14_1 motif. The next most efficient substrates contained the pair of motifs where MMP14_1 was followed directly by ADAM17_2. The single or double MMP14_1 motif-bearing peptides were next in the order. An unanticipated result was that the FAPa 1 motif was also cleaved within the peptides bearing FAPα_1 directly followed by the CTSL1_1 motif at PGGPAGIIGALF (SEQ ID NO: 247); these were lower efficiency cleavages. The FAPa 1 motif was not cleaved by MMP9, however, when followed either by the ADAM17_2 motif or the spacing residues GG. The slowest peptides bear the MMP14_1 motif near the C-terminus of the 30-mer peptide. From this experiment, a trend emerged that MMP9 has additional sequence preferences in the downstream prime-side positions, and that the combination of MMP14_1 upstream of ADAM17_2 is most efficient.

To better understand the intrinsic rates of product formation with MMP9 treatment, it is also possible to monitor the cleavage products at a specific peptide bond in these experiments. A comparison of peptides bearing one, two or three MMP14_1 tandem motifs is shown in FIG. 50. The most rapidly degraded peptides were those bearing three repeat motifs of MMP14_1 (top panel). Overall, the peptides bearing one or two MMP14_1 motifs were degraded at approximately the same rate (top panel). However, considering intrinsic rates of bond cleavage at individual sites, the cleavage product of Alu30-2 at bond 9 appeared more rapidly than the cleavage product of Alu30-1 at bond 16 or of Alu30-2 at bond 21 (bottom panel). Thus, the specific cleavage of the Alu30-2 peptide was more efficient than the Alu30-1 peptide. These individual bond cleavage events are monitored by tracking unique peptide fragments, and although too complex for data fitting, the ranking of products is possible.

FAPα was able to cleave both FAPα_1 and MMP14_1 motifs, at PGGP|AGIG (SEQ ID NO: 197) and GP|AGLYAQ (SEQ ID NO: 195) respectively. Degradation of the 30-mer peptides by FAPα showed highest cleavage activity toward the peptides bearing tandem MMP14_1 motifs (FIG. 50, Alu30-4 or Alu30-3). The peptide bearing two MMP14_1 motifs (Alu30-2) was also efficiently cleaved. FAPα_1 motifs were cleaved more efficiently when followed by the ADAM17_1 or ADAM17_2 motifs than when followed by CTSL1_1 or CTSL1_2. Among these peptides, the Lys-bearing ADAM17_2 or CTSL1_1 motifs were lower efficiency than the new motifs tested in this experiment, ADAM17_1 and CTSL1_2.

Another trend was a preference for cleavage of the FAPα_1 motif in the first or second position relative to the N-terminus of these peptides. When the FAPα_1 motif was in the third position closest to the C-terminus, these peptides were not cleaved (Alu30-7 or Alu30-8). The MMP14_1 motif was readily cleaved in the third position closest to the C-terminus, but this was most evident in the tandem MMP14_1 motif-bearing peptides, where N-terminal cleavages assist in shortening the 30-mer. Thus, it may be that FAPα could serve as a secondary-cleaving enzyme after activation with a first enzyme elsewhere in a hybrid linker design.

CTSL1 treatment of the 30-mer peptide library produced cleavages in all peptides bearing a CTSL1_1 or CTSL1_2 motif (FIG. 51). The most efficiently cleaved peptides were those containing the FAPa 1, CTSL1_1 and ADAM17_2 motifs, in multiple orders. Peptides bearing the MMP14_1 motif with CTSL1_1 and ADAM17_2 were slightly lower efficiency. CTSL1 motifs in the middle of the 30-mer peptides were also favorable, thus CTSL1 may be able to serve as a first cleavage in the hybrid motifs.

ADAM17 produced cleavages in all peptides bearing an ADAM17_I or ADAM17_2 motif as well (FIG. 52). The most efficient peptide cleavages occurred in the peptides containing ADAM17_2, CTSL1_1 and FAPa 1 motifs. Slightly lower efficiency cleavages were obtained in peptides containing the MMP14_1 with ADAM17_2 and CTSL1_1. Peptides bearing only the MMP14_1 motif were not cleaved. Peptides Alu30-9 and Alu30-17, containing the ADAM17_2 and ADAM17_1 motifs respectively, had similar cleavage efficiencies.

Counter-screening with Thrombin, Factor Xa and Hepsin was also performed following the same analysis. The library peptide Alu30-19 was designed to include authentic sites for each enzyme, for comparison of overall cleavage efficiency as well as cleavage site specificity within each motif. The substrate designed for Factor Xa has the motif FNPR|TFGS (SEQ ID NO: 248), derived from the Factor Xa cleavage site in Thrombin. The substrate motif for Thrombin was FPR|, a common tool substrate motif. The substrate motif for hepsin was RKRR|GSRG (SEQ ID NO: 249) from filaggrin.

Shown in FIG. 53 are the results of Factor Xa cleavage. The authentic cleavage site motif was Peptide Alu30-19 with this motif was completely degraded before the 5 min time point.

Products of the Alu30-19 cleavage were formed from all three sites in this peptide. In comparison, the only library peptide with significant cleavage was Alu30-5, cleaved at the CTSL1_1 motif ALFKS|SFP (SEQ ID NO: 198), upstream of a FAPa 1 motif.

Otherwise, all other peptides bearing a CTSL1_1 motif were cleaved by Factor Xa at either ALF|KSSFP (SEQ ID NO: 198) or ALFKS|SFP (SEQ ID NO: 198). The ADAM17 motifs were also cleaved at KLK|SSGP (SEQ ID NO: 250), KLKSS|ALF (SEQ ID NO: 251), or RLR|SSALF SEQ ID NO: 252), but these cleavages were all lower efficiency. The peptide with the motif CTSL1_2 was cleaved at the lowest efficiency.

Thrombin showed higher activity than Factor Xa, and it cleaved each of the 30-mer peptides. The MMP14_1 motifs were cleaved at GPAG|LYAQ (SEQ ID NO: 195), the CTSL1_1 motifs at ALFK|SSFP (SEQ ID NO: 198), and the ADAM17_2 motifs at LAQK|LKSS (SEQ ID NO: 201) or LAQKLK|SS (SEQ ID NO: 201) (or LAQR|LRSS (SEQ ID NO: 200) and LAQRL|SS (SEQ ID NO: 253) in ADAM17_1). The two alternate ADAM17 motifs were cleaved with similar efficiency (peptides Alu30-17 vs Alu30-9). However, the CTSL1_2 motif had lower cleavage activity than did the CTSL1_1 motif (peptides Alu30-18 vs Alu30-6). The peptides Alu30-1 and Alu30-3 were the most rapidly cleaved in the library, and Alu30-4 was also an efficient substrate, showing the susceptibility of MMP14_1 motifs in this experiment. The peptide Alu30-2, bearing two MMP14_I motifs, was less susceptible to thrombin, however, potentially due to altered spacing with additional glycine residues between motifs. Also, the peptides Alu30-12, Alu30-13 and Alu30-15, with MMP14 1 motifs in combination with ADAM17_2 and CTSL1_1, were cleaved at lower efficiency by thrombin. Thus, increased spacing between the motifs or specific arrangements may rescue a thrombin-susceptible linker design (FIG. 54).

The favored arrangements for reducing thrombin susceptibility include using ADAM17_2 upstream of CTSL1_1, and CTSL1_1 upstream of FAPa 1.

Finally, hepsin treatment of the 30-mer library produced lower efficiency cleavages overall (FIG. 55). The kinetics of these peptide degradation reactions were complex due to the formation of multiple cleavage produces; for example, Alu30-19 was cleaved at all three motifs within the first 15 min of the reaction at RKRR| (SEQ ID NO: 254), FPR| and FNPR| (SEQ ID NO: 255). The literature value for the catalytic efficiency of a FRET peptide bearing this motif was $3.5 \times 10^5$ $M^{-1}$ $s^{-1}$. The authentic peptide Alu30-19, as well as the top cleaved peptides Alu30-8,-9 , −12, and −14 all had apparent catalytic efficiencies on the same order of $10^5$ $M^{-1}s^{-1}$. The features that made peptides more susceptible to hepsin appear to be placement of an ADAM17_2 motif in the second motif position of the peptide, or in the combination of ADAM17_2 followed by CTSL1_1. In general, the library peptides were all cleaved at P1 Lys sites, QKLK| (SEQ ID NO: 256) or ALFK| (SEQ ID NO: 257). The ADAM17_1 motif was less efficiently cleaved than ADAM17_2, and the alternate CTSL1_2 motif was also cleaved at a much slower rate than CTSL1_1.

To conclude, the tandem linker analysis with mass spectrometric detection revealed motif order preferences and unexpected side-reactions.

Example 35: 30-Mer Tandem Linker Design

To generate the most efficient tandem linker, the cleavage efficiencies for each of the targeted enzymes toward the 30-mer library peptides can be compared (FIG. 64).

The tandem linker with the arrangement of ADAM17_2-MMP14_1-CTSL1_1 in the peptide Alu30-16 had generally high activity toward the full set of five targeted enzymes, as well as the lowest susceptibility to thrombin, Factor Xa, and hepsin. The next best configuration was MMP14_1-ADAM17_2-CTSL1_1 in Alu30-15 which, although it had slightly higher hepsin susceptibility and lower CTSL1 activity may be rescued by the replacement with the CTSL1_2 motif. Replacement of the ADAM17_2 motif with ADAM17_i may also enhance activity toward FAP-alpha and CTSL1, even if ADAM17 activity enhancement is minor, and hepsin susceptibility would be predicted to be reduced.

Example 36. Stability in Serum and Plasma

The stability of constructs of interest was measured in human or mouse serum. Each construct (approximately 30 mg/mL) was combined with serum (1:9 ratio of construct to serum), MMP9, or PBS. The mixture was incubated at 37° C. for 24 or 72 hours. Samples were taken at T=0 hours for comparison. After incubation, samples were diluted 1:500 (in human serum, FIG. 56) or 1:200 (in mouse serum, FIG. 57) in PBS and run on an SDS PAGE gel for western blot analysis. A polyclonal anti-IL-2 antibody (R&D Systems) was used to probe the blots. Results are shown in FIG. 56 and FIG. 57.

Example 37. IL-2 Serum Stability

The stability of IL2 fusion proteins in human serum (normal and cancer patient) was measured using capillary electrophoresis-based immunoassays (Jess instrument, Protein Simple). Fusion proteins were concentrated to 10 mg/ml and incubated with serum (90%). A time zero sample was immediately stored on ice while 24 hour and 72 hour samples were placed at 37° C. Post incubation, samples were diluted 1:1000 with 0.1× sample buffer (Protein Simple) and loaded on the Jess cartridge per the manufacturer's protocol. The primary antibody was a monoclonal human IL2 antibody (R&D Systems, cat #AF-202-NA, stock concentration 0.2 mg/ml, working concentration 1:100), and the secondary antibody was a peroxidase-conjugated AffiniPure Bovine Anti Goat IgG (H+L) (Jackson Immuno Research, cat #805-035-18, reconstituted at 0.8 mg/ml, working concentration 1:5000 dilution). All antibodies were diluted in milk free diluent (Protein Simple). Quantitation of IL2 containing species was quantitated using Compass software (Protein Simple) to determine the extent of cleavage (i.e. amount of IL2 containing species smaller than the input fusion protein). Results are shown in FIGS. 24A-24B.

Example 38: Tissue Stability

Primary human lung epithelial cells and renal epithelial cells were obtained from ATCC. Primary hepatocytes were obtained from Lonza and Sigma. Cells were thawed, counted, and plated at 1e4 cells per well in a 96 well round bottom plate in their respective growth medias.

Figure 5:
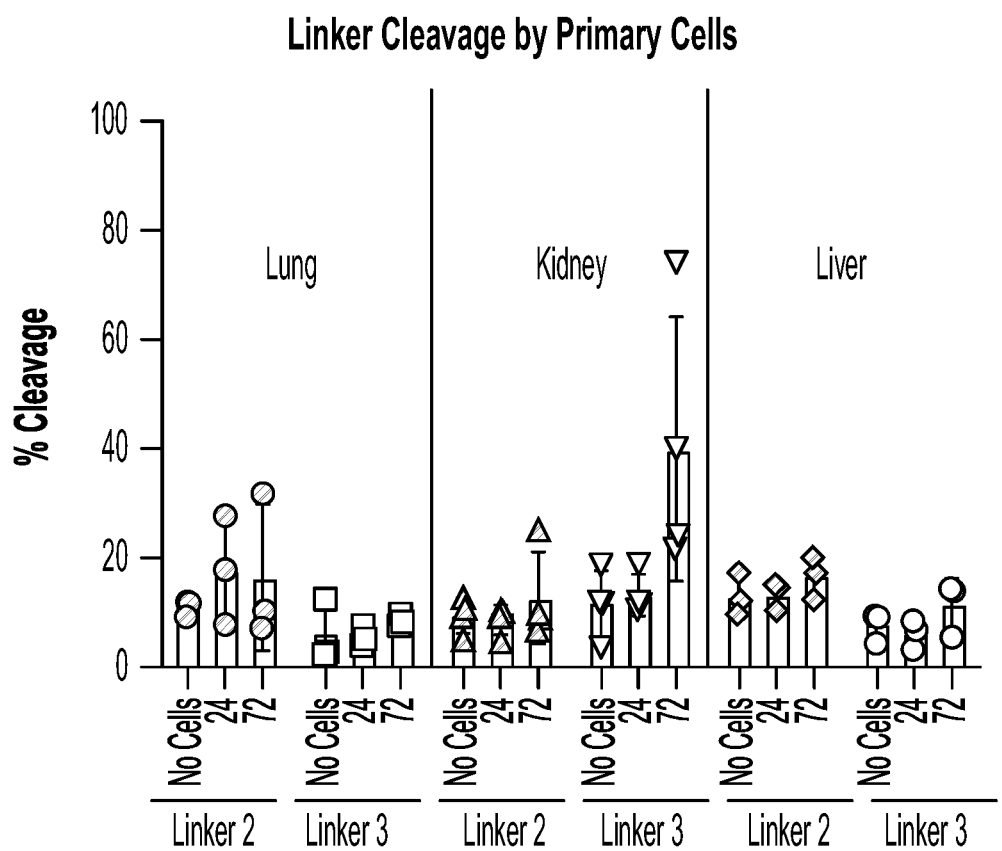

Polypeptides containing recombinant human IL-2 and the sequence for Linker-2 and Linker-3 were incubated with cells or media alone for 24 and 72 hours at a concentration 51.1 g/mL. Cell culture supernatants were collected, and cells were discarded. Protein cleavage was measured by western blot for IL-2 using the protein simple JESS system and Compass software. Results are shown in FIG. 5.

Figure 6A:
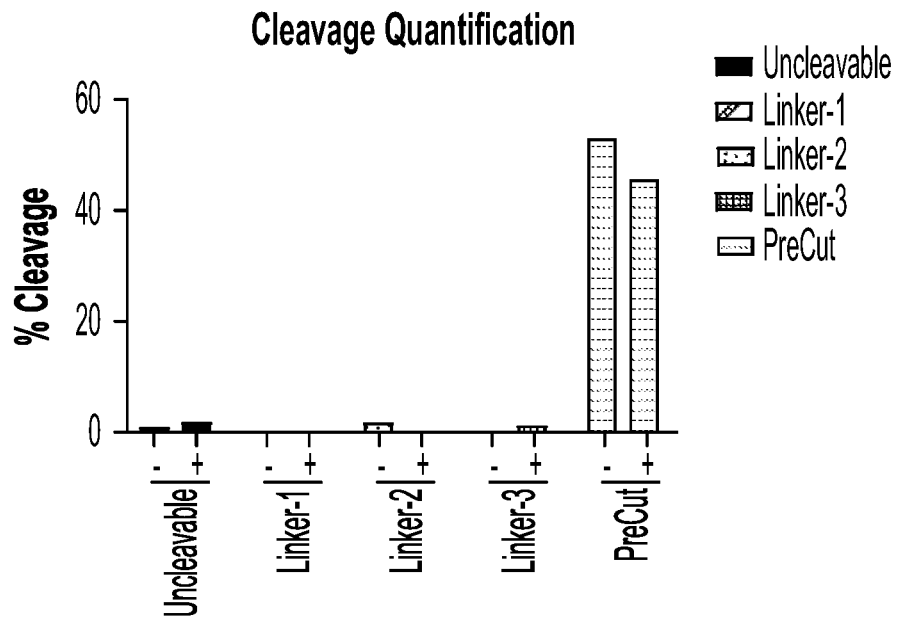
Figure 6B:
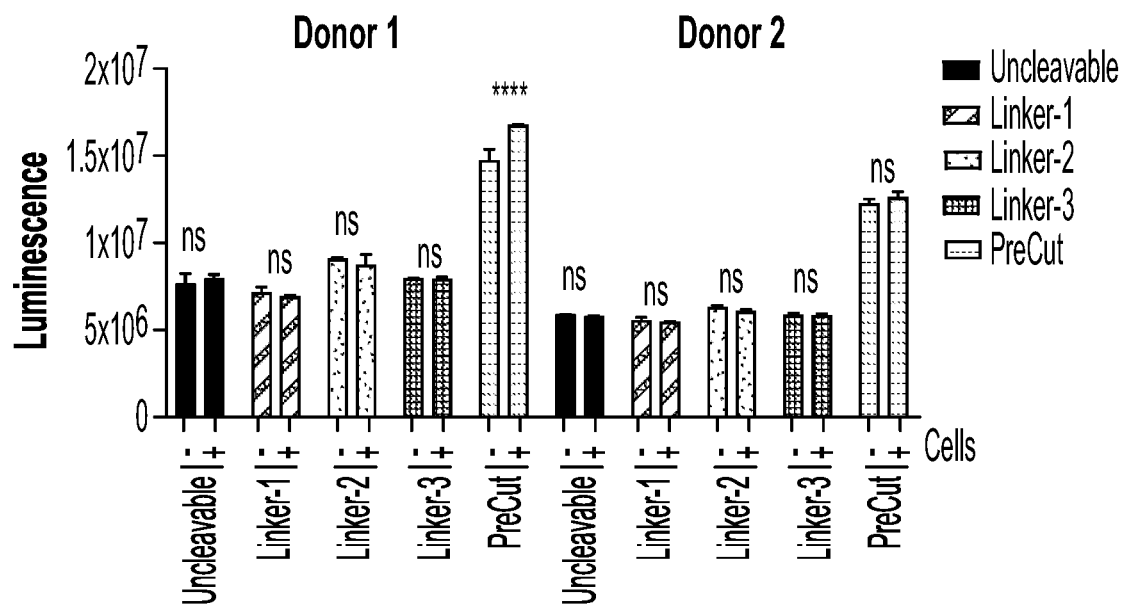
Figure 7A:
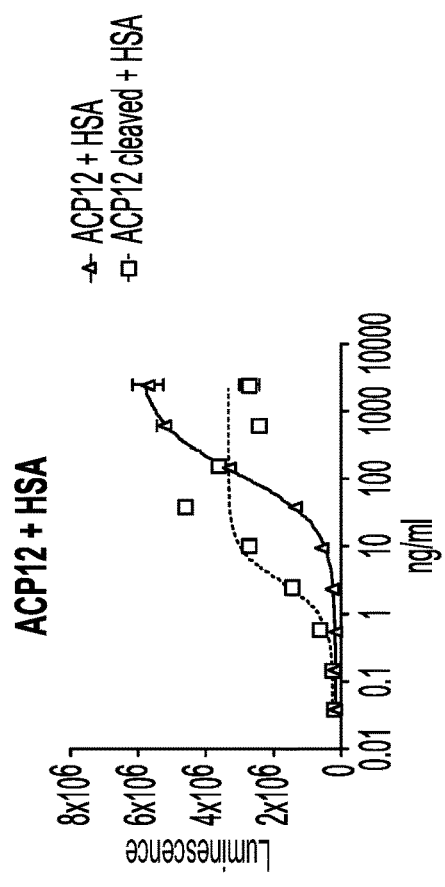
Figure 7B:
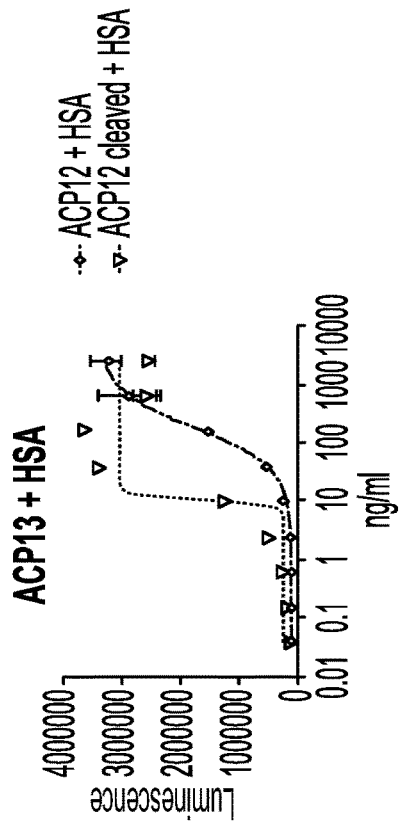
Figure 7C:
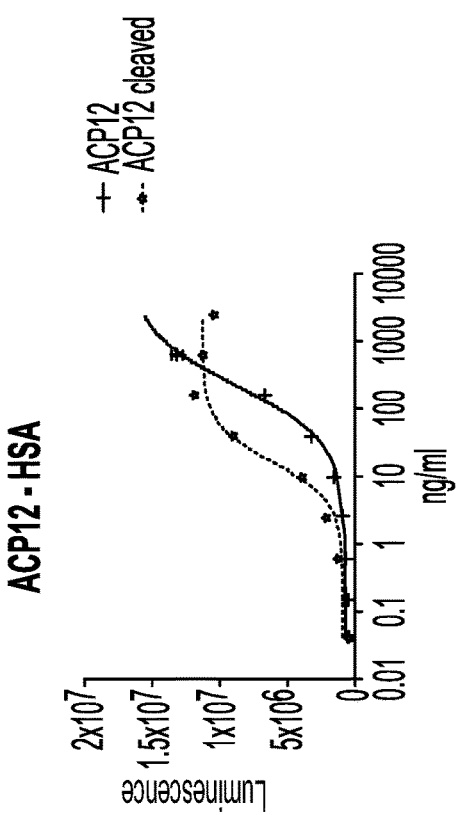
Figure 7D:
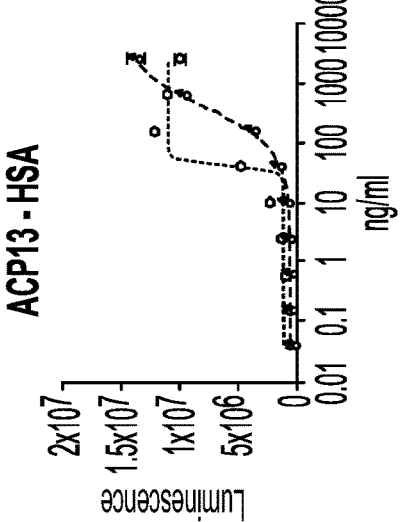
Figure 7E:
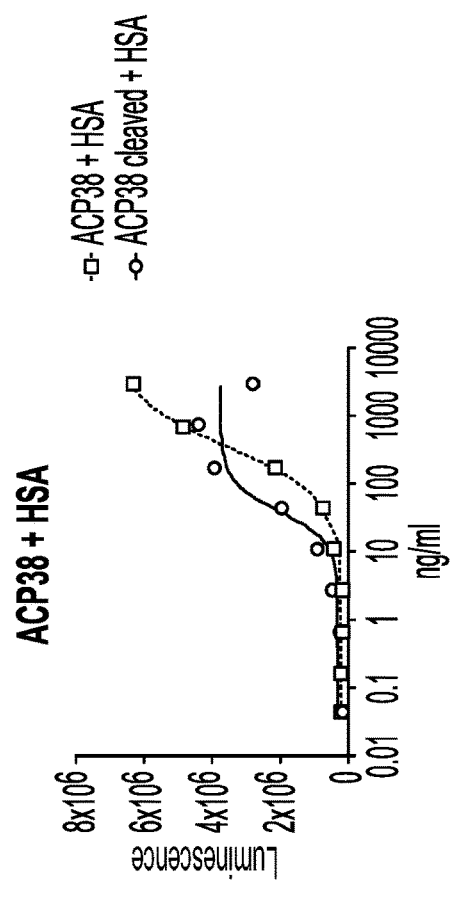
Figure 7F:
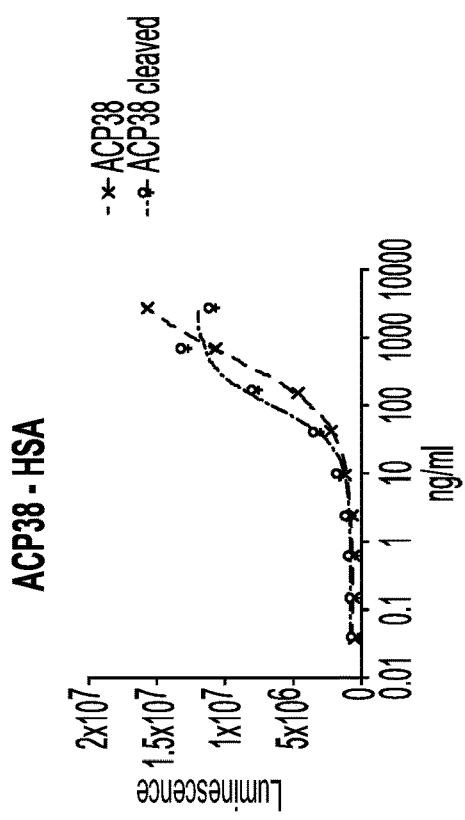
Figure 7G:
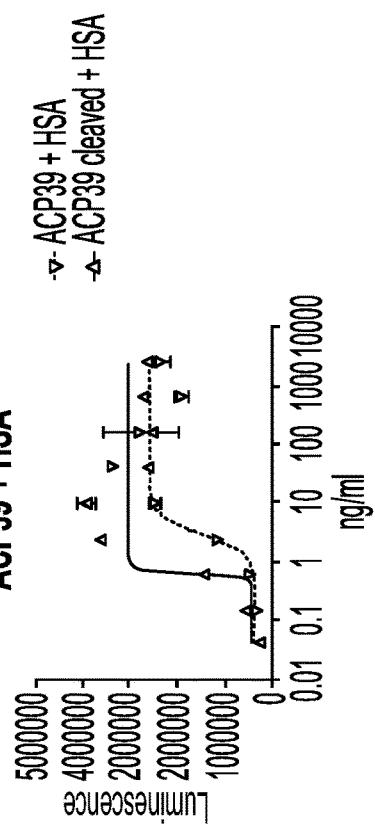
Figure 7H:
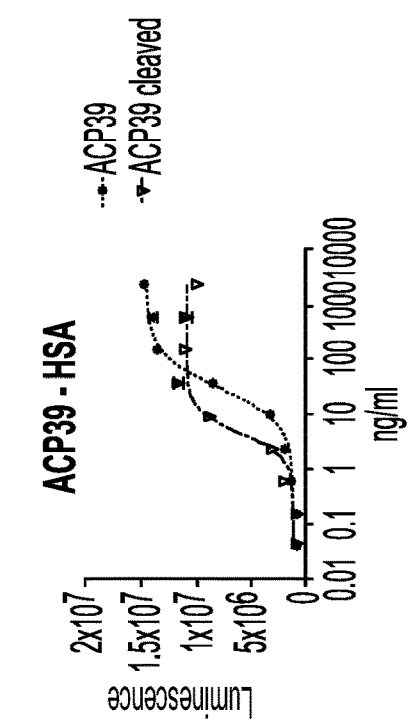
Figure 9H:
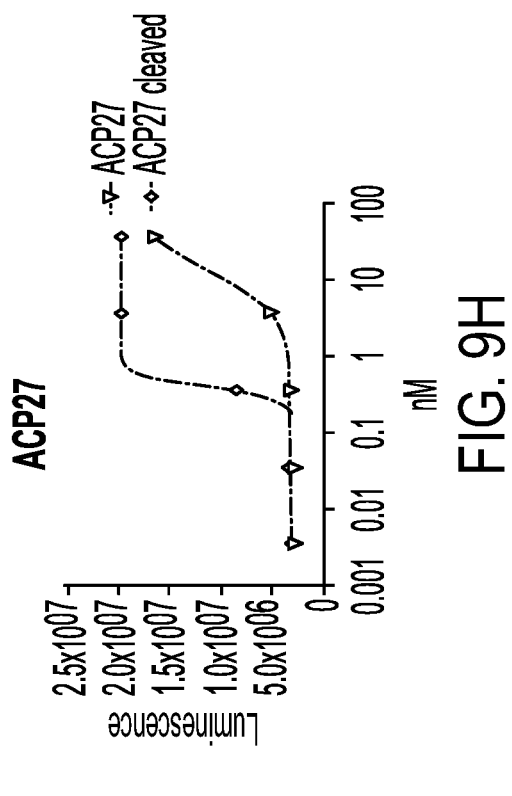
Figure 9J:
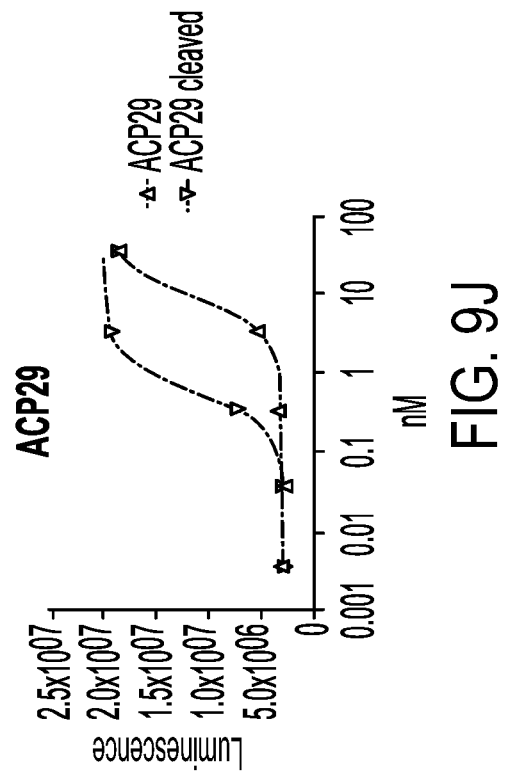
Figure 9G:
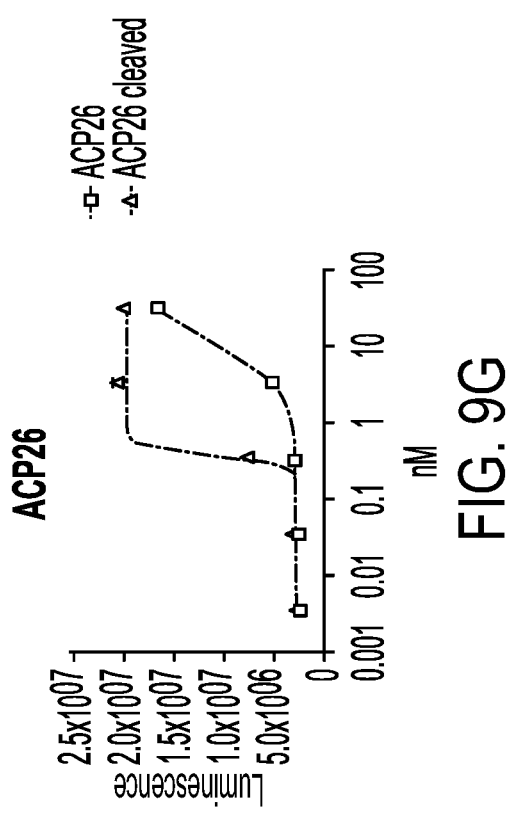
Figure 9I:
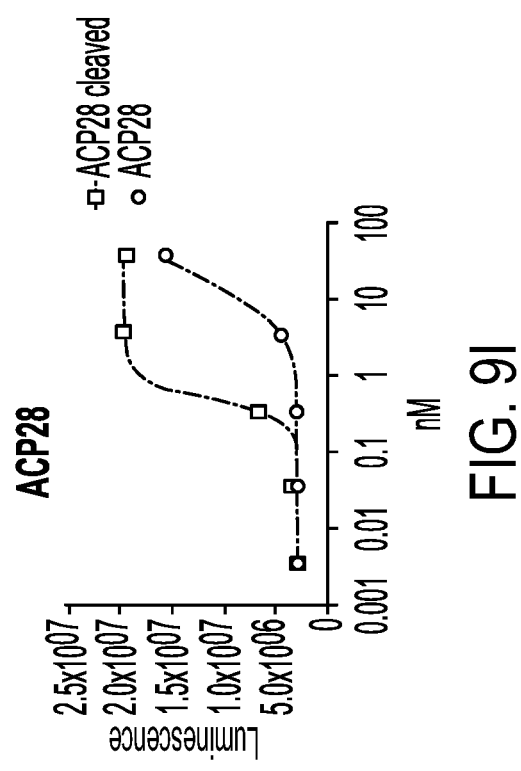
Figure 9Q:
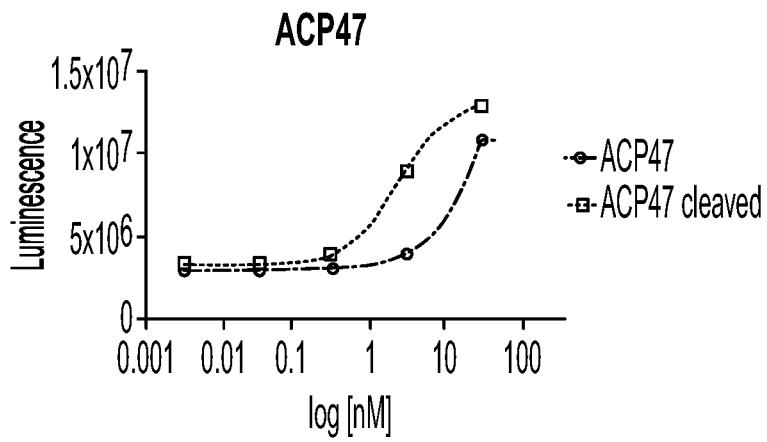
Figure 9R:
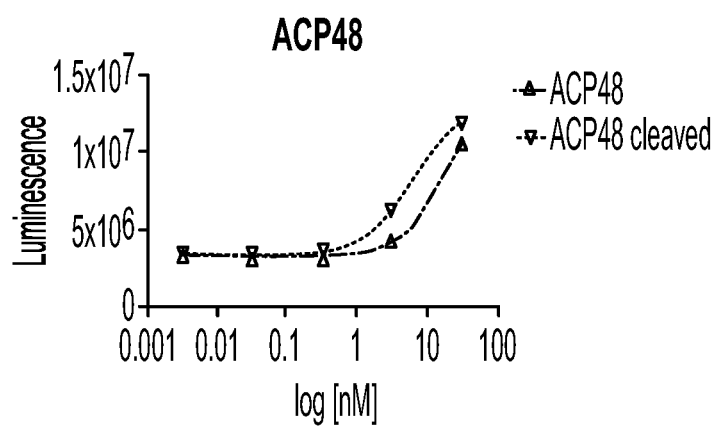
Figure 9S:
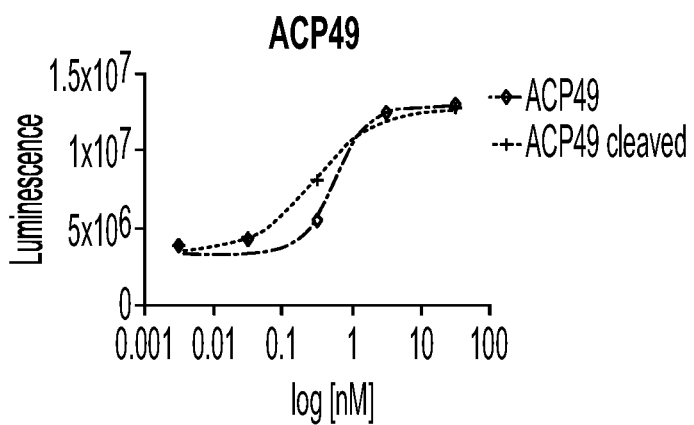
Figure 9U:
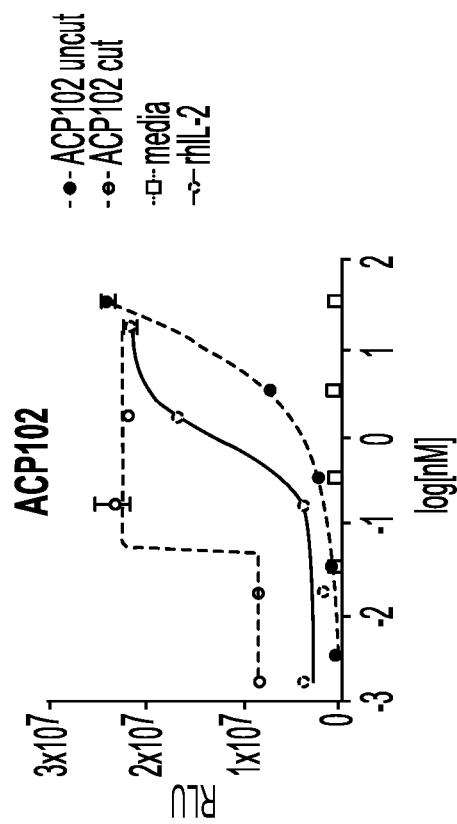
Figure 9T:
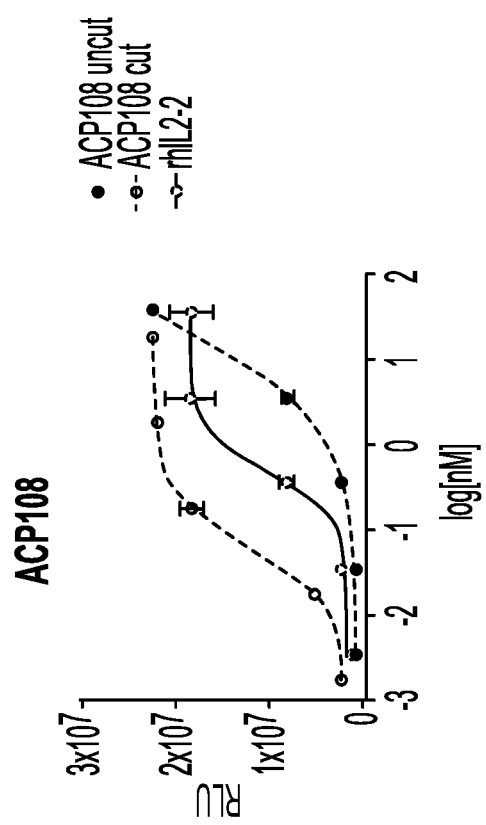
Figure 9V:
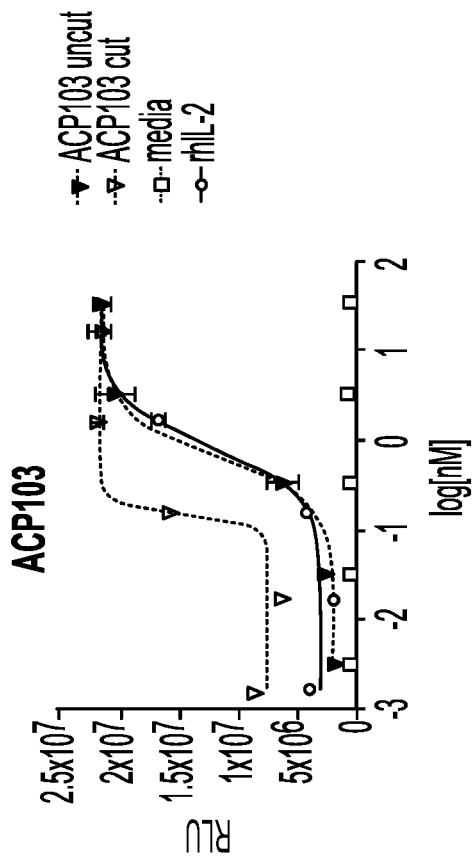
Figure 9X:
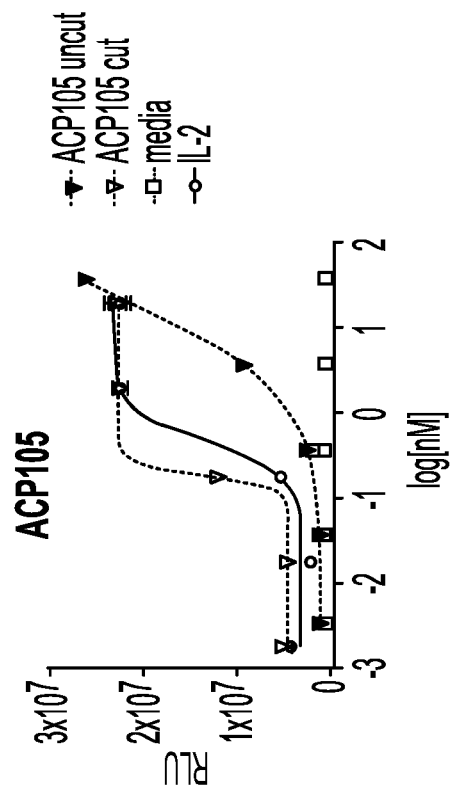
Figure 9W:
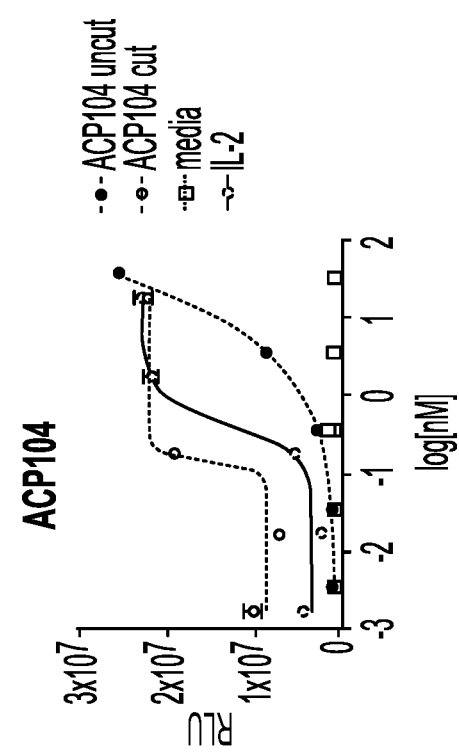
Figure 9Z:
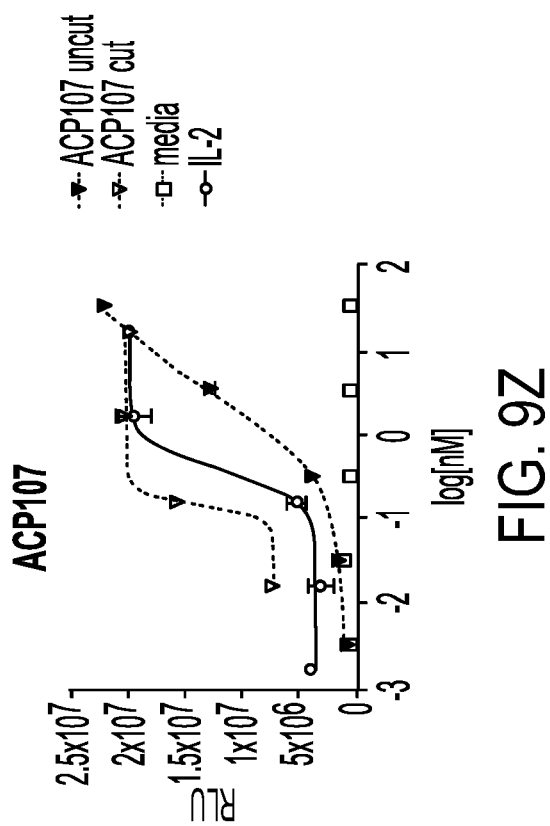
Figure 9Y:
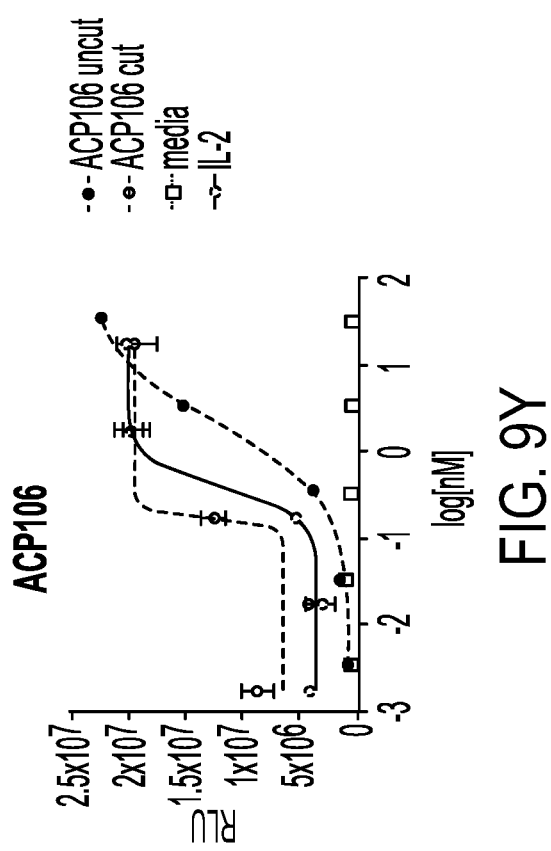
Figure 10:
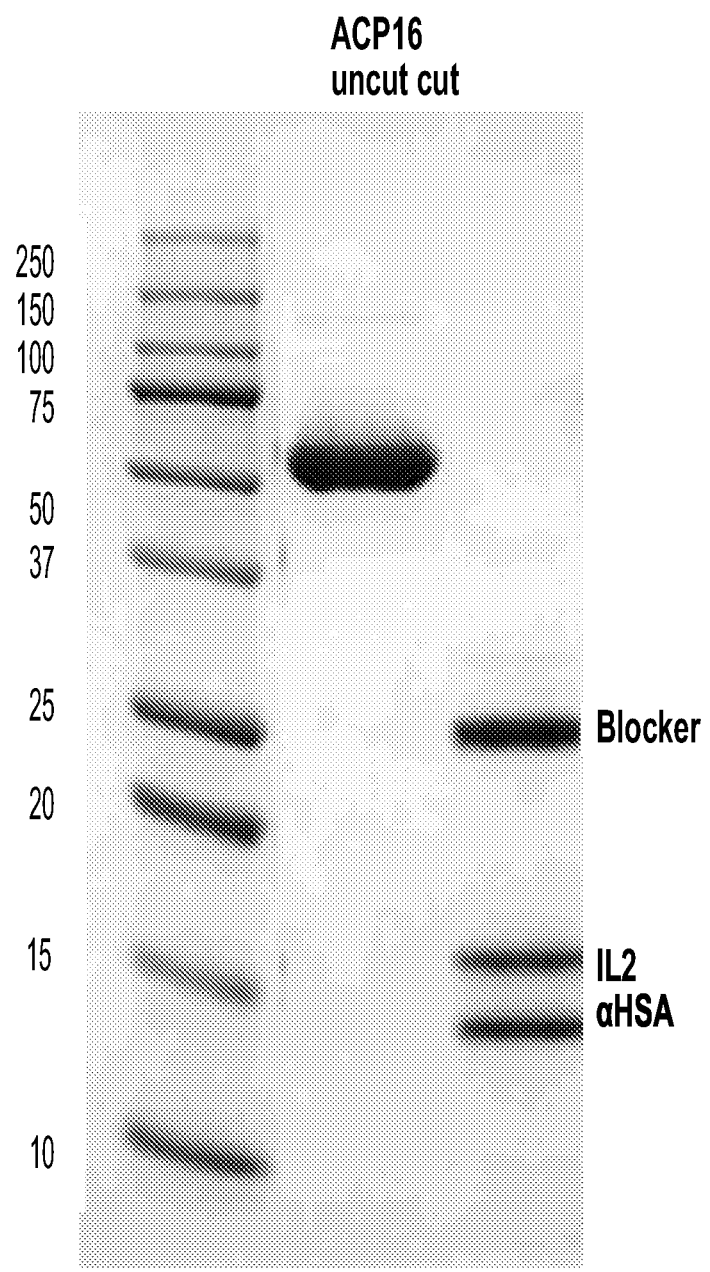
Figure 12E:
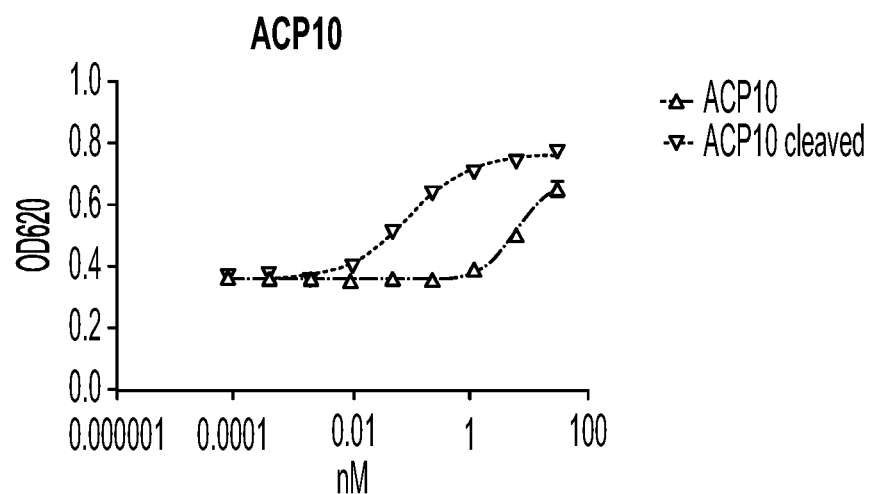
Figure 12F:
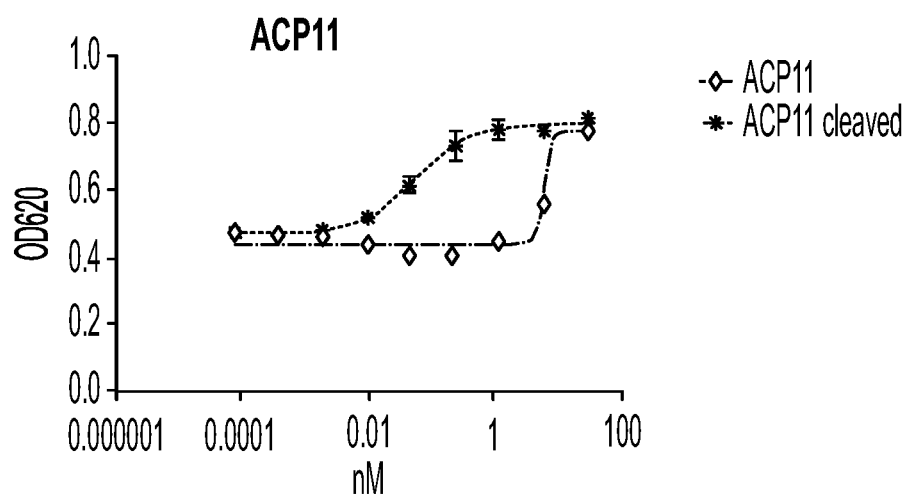
Figure 13:
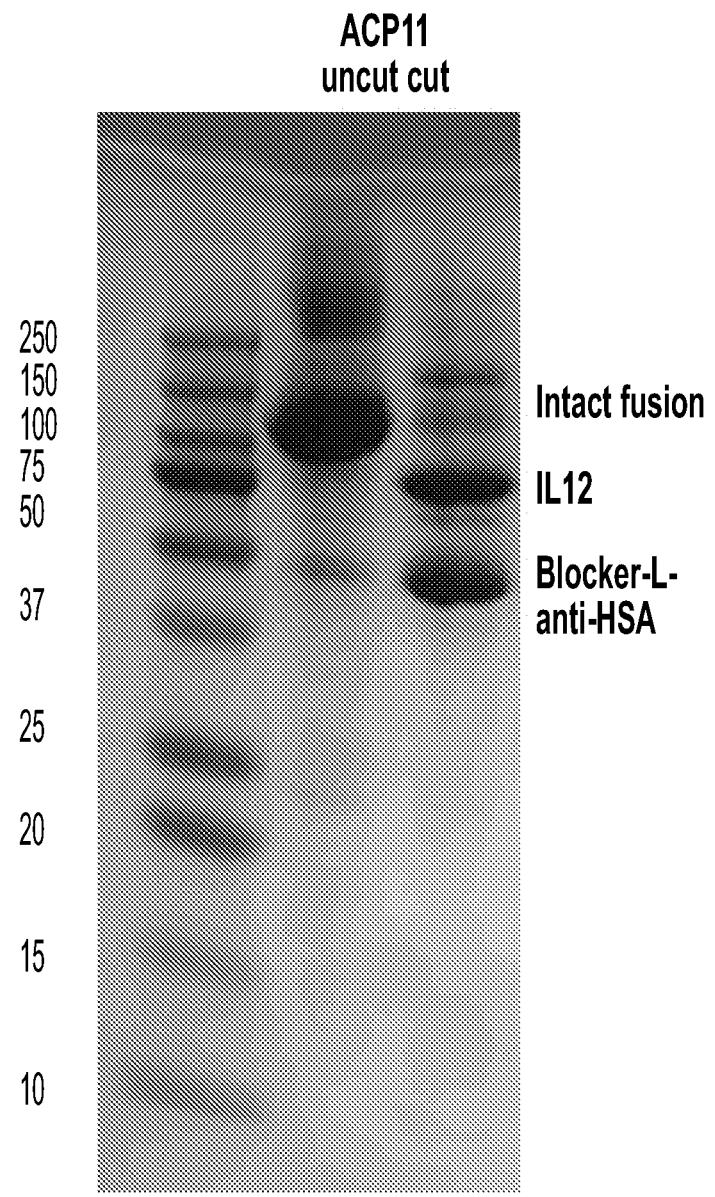
Figure 14:
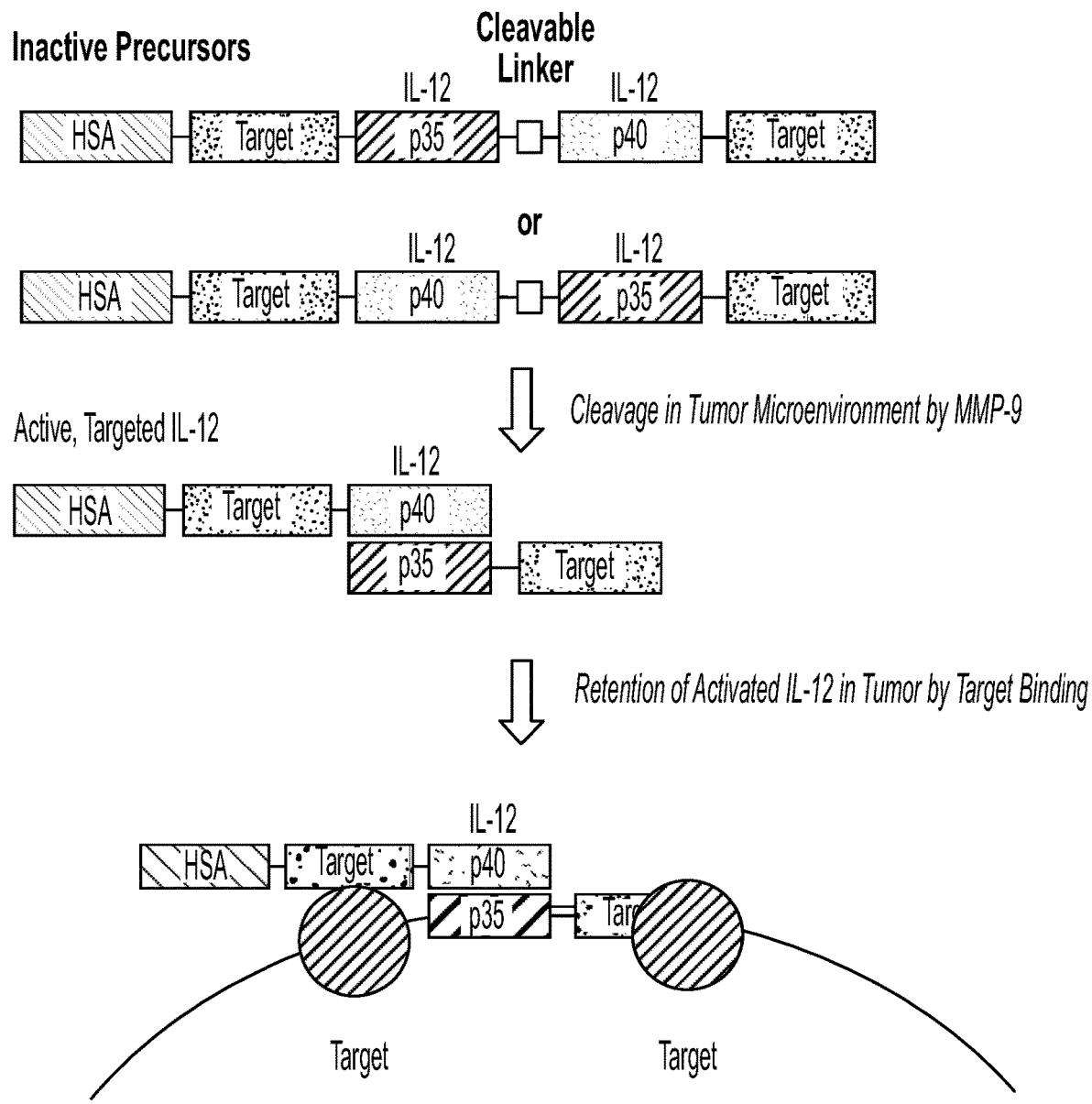
Figure 15A:
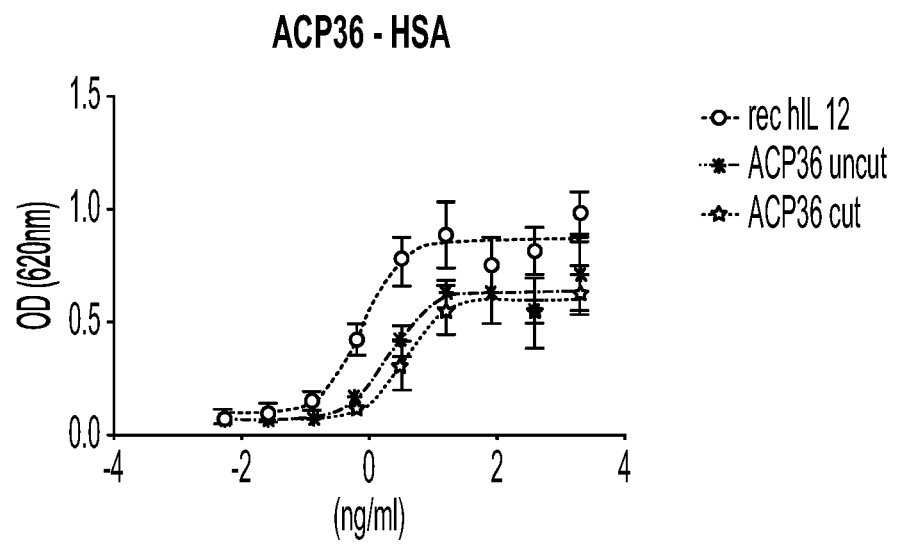
Figure 15B:
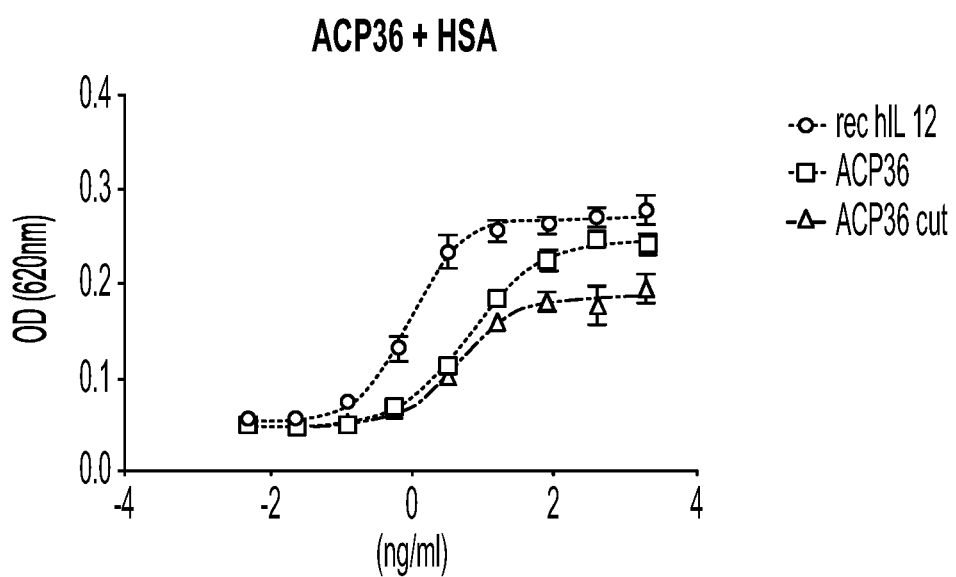
Figure 15C:
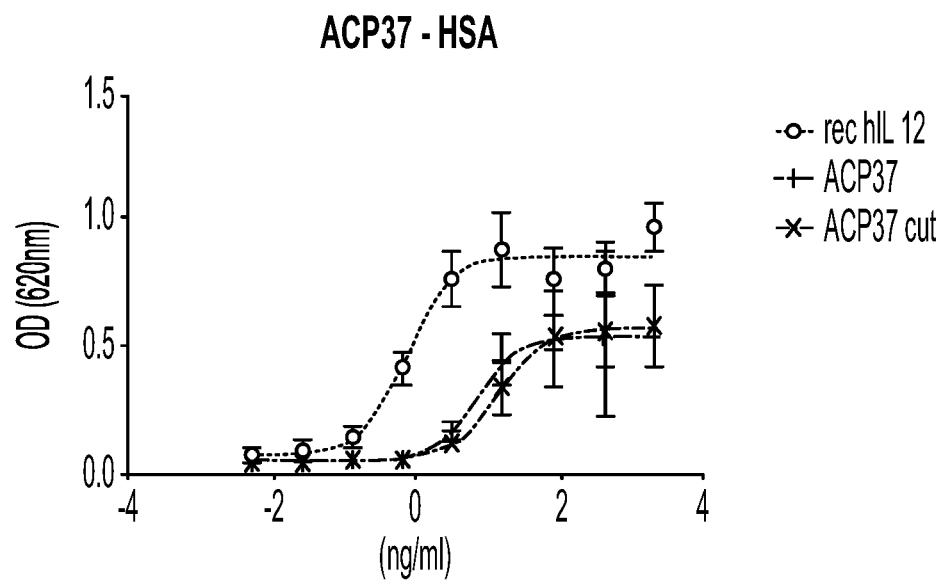
Figure 15D:
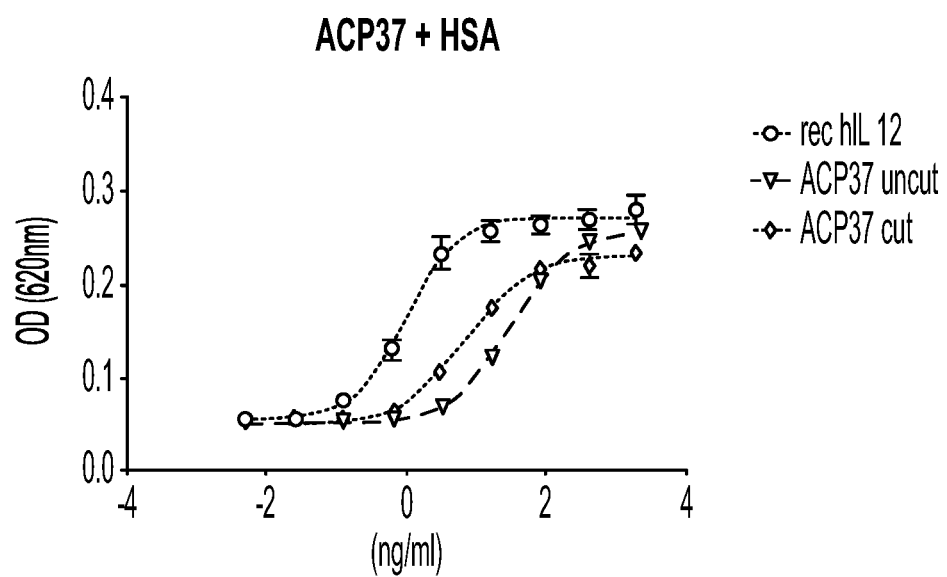
Figure 18A:
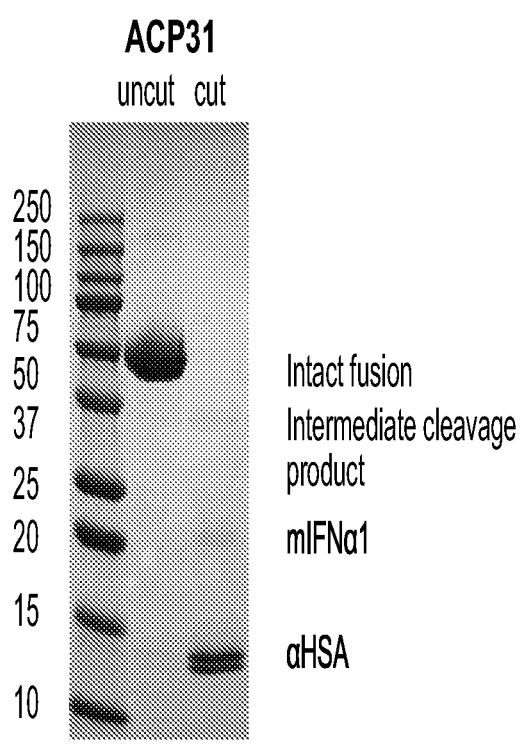
Figure 18B:
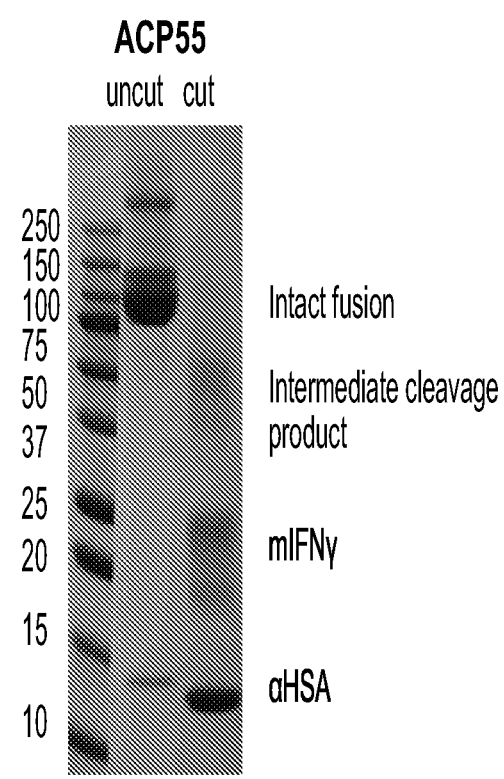

Primary human lung fibroblasts were obtained from ATCC. Prior to the processing assay, human PBMCs were stimulated with 5 ug/mL PHA for 72 hours to generate T blasts, which were then frozen and used to measure polypeptide processing. Primary human fibroblasts were thawed, counted, and plated at 1e5 cells per well in a 96 well round bottom plate in X-Vivo 15 media. Polypeptides containing recombinant human IL-2 and the sequence for Linker-1 (GPAGMKGL, SEQ ID NO: 196), Linker-2 (GPAGLYAQ, SEQ ID NO: 195), or Linker-3 (ALFKSSFP, SEQ ID NO: 198), or a non-cleavable sequence were incubated with or without fibroblasts cells for 48 hours at a concentration of either A) 3.3 nM or B) 0.33 nM. As a positive control, some wells were also incubated with a polypeptide that was pre-cut in vitro overnight with 1 μg pre-activated MMP9 enzyme at 37° C. After 48 hours, cell culture supernatants were collected and healthy fibroblasts were discarded. Polypeptide processing was measured either by A) western blot for IL-2 using the protein simple JESS system, or by B) measuring the capacity of the cell culture supernatants to stimulate T blast proliferation. Briefly, T blasts were incubated for 72 hours with cell culture supernatants containing polypeptides previously exposed to healthy human fibroblasts, before T blast proliferation was measured by Cell Titer Glow analysis. Results are shown in FIG. 6A-6B.

Example 39: Linker-2 is Efficiently Cleaved in Human Tumor Cells

Cleavage efficiency of Linker-2 (GPAGLYAQ, SEQ ID NO: 195) was evaluated in tumor tissue derived from human samples. A total of 66 samples were analyzed from seven solid tumor types. The tumor types are shown in Table 5 below.

Briefly, frozen dissociated tumor cells (DTC) were thawed, counted and plated in X-Vivo media. Cells or "No Cell Control" wells were incubated with an inducible IL-2 cytokine containing Linker 1 (a cleavable linker that was not designed using the processes described herein) or Linker-2 (GPAGLYAQ, SEQ ID NO: 195). These inducible IL-2 proteins have no or minimal IL-2 biological activity when the linker is intact, and IL-2 biological activity is induced when the linker is cleaved. Cell culture supernatants were collected and frozen before analysis for IL-2 biological activity using T-Blast proliferation and Jess protein assays. The minimum fold change in IL-2 activity is 1.00, and the maximum is 2.50. A 1.3 fold change is indicative of a significant increase in biological activity relative to the uncleaved control. Table 5 shows the average fold change for Linker-2 (GPAGLYAQ, SEQ ID NO: 195) in comparison to an uncleaved control, a cleaved control, and Linker-1. In Table 12 the symbol "−" indicate essentially no increase in activity; "+/−" indicates some increase in activity but not significant; "+," "++," and "+++" indicate the relative significant increase in activity compared to the uncleavable control. Linker-2 is sufficiently cleaved in human tumor types to induce IL-2 biological activity.

TABLE 12

Cleavage efficiency of Linker-2 in human tumor types

| | | Average Fold Change Over Non-Cleavable | | |
|---|---|---|---|---|
| Diagnosis | Uncleavable | Linker 1 | Linker 2 | Pre-cut |
| Melanoma (n = 8) | − | − | +/− | +++ |
| Kidney Cancer, Renal Cell Carcinoma (n = 11) | − | − | + | +++ |
| Head and Neck Cancer, Squamous Cell (n = 6) | − | +/− | +++ | +++ |
| Colorectal Cancer, Adenocarcinoma (n = 10) | − | +/− | + | +++ |
| Lung Cancer, Squamous Cell Carcinoma (n = 13) | − | − | ++ | +++ |
| Lung Cancer, Adenocarcinoma (n = 10) | − | − | + | +++ |
| Breast Cancer (n = 5) | − | − | +/− | +++ |

Example 40: Linker-3 is Efficiently Cleaved in Human Tumor Cells

Cleavage efficiency of Linker-3 (ALFKSSFP, SEQ ID NO: 198) was evaluated in tumor tissue derived from human samples. A total of 66 samples were analyzed from seven solid tumor types. The tumor types are shown in Table 6 below.

Briefly, frozen DTC cells were thawed, counted and plated in X-Vivo media. Cells or "No Cell Control" wells were incubated with an inducible IL-2 cytokine containing Linker 1 (a cleavable linker that was not designed using the processes described herein) or Linker-2 (GPAGLYAQ, SEQ ID NO: 195). These inducible IL-2 proteins have no or minimal IL-2 biological activity when the linker is intact, and IL-2 biological activity is induced when the linker is cleaved. Cell culture supernatants were collected and frozen before analysis for IL-2 biological activity using T-Blast proliferation and Jess protein assays.

The minimum fold change in IL-2 activity is 1.00, and the maximum is 2.50. A 1.3 fold change is indicative of a significant increase in biological activity relative to the uncleaved control. Table 6 shows the average fold change for Linker-3 (ALFKSSFP, SEQ ID NO: 198) in comparison to an uncleaved control, a cleaved control, and Linker 1. In Table 13 the symbol "−" indicate essentially no increase in activity; "+/−" indicates some increase in activity but not significant; "+," "++," and "+++" indicate the relative significant increase in activity compared to the uncleavable control. Linker-3 (ALFKSSFP, SEQ ID NO: 198) is sufficiently cleaved in human tumor types to induce IL-2 biological activity.

TABLE 13

Cleavage efficiency of Linker-3 in human tumor types

| | | Average Fold Change Over Non-Cleavable | | |
|---|---|---|---|---|
| Diagnosis | Uncleavable | Linker 1 | Linker 3 | Pre-cut |
| Melanoma (n = 8) | − | − | + | +++ |
| Kidney Cancer, Renal Cell Carcinoma (n = 11) | − | − | + | +++ |
| Head and Neck Cancer, Squamous Cell (n = 6) | − | +/− | +++ | +++ |
| Colorectal Cancer, Adenocarcinoma (n = 10) | − | +/− | +++ | +++ |
| Lung Cancer, Squamous Cell Carcinoma (n = 13) | − | − | +++ | +++ |
| Lung Cancer, Adenocarcinoma (n = 10) | − | − | +++ | +++ |
| Breast Cancer (n = 5) | − | − | + | +++ |

Example 41: Measuring Inducibility of Agonist Anti-4-1BB Antibodies

A stable HT-1080 cell line expressing human 4-1BB was established. Agonism of human-4-1BB in these cells resulted in increased secretion of IL-8. Tetravalent monospecific antibodies, inducible format tetravalent monospecific antibodies (protease cleaved or uncleaved), or trimeric ligands were tested for ability to agonize 4-1BB.

Before addition to the cultured cells, some samples of the antibody to be tested were incubated with an appropriate protease under suitable conditions for proteolysis. Some samples were maintained in an uncleaved state. The extent of inducibility was determined by comparison of uncleaved (uninduced) inducible format tetravalent monospecific antibody with the corresponding protease cleaved inducible format tetravalent monospecific antibody.

After incubation at 37° C. and 5% $CO_2$ for 6 hours, the agonistic activities of the cleaved and uncleaved antibodies were evaluated by the quantification of IL-8 production using an IL-8 AlphaLISA or ELISA. The EC50s and maximum IL-8 levels were compared. Results are shown in FIG. 65A-65B.

Example 42: Protease Cleavage of Anti-4-1BB Antibodies by MMP9

One of skill in the art would be familiar with methods of setting up protein cleavage assay. 100 μg of protein in 1×PBS pH 7.4 were cleaved with 1 jig active MMP9 (Sigma catalog #SAE0078-50 or Enzo catalog BML-SE360) and incubated at room temperature for up to 16 hours. Digested protein is subsequently used in functional assays or stored at −80° C. prior to testing. The extent of cleavage was monitored by SDS PAGE using methods well known in the art.

Example 43: Protease Cleavage of Anti-4-1BB Antibodies by MMP14 or CTSL1

One of skill in an be replaced with Linker-3. the art would be familiar with methods of setting up protein cleavage assay. 100 jig of protein in 1×PBS pH 7.4 are cleaved with 1 jig active MMP14 (R&D Systems Catalog #9518-MP-010) or CTSL1 (R&D Systems Catalog #952-CY) and incubated at room temperature for up to 16 hours. Digested protein are subsequently used in functional assays or stored at −80° C. prior to testing. The extent of cleavage is monitored by SDS PAGE using methods well known in the art.

8. Other Embodiments

The disclosure set forth above may encompass multiple distinct inventions with independent utility. Although each of these inventions has been disclosed in its preferred form(s), the specific embodiments thereof as disclosed and illustrated herein are not to be considered in a limiting sense, because numerous variations are possible. The subject matter of the inventions includes all novel and nonobvious combinations and subcombinations of the various elements, features, functions, and/or properties disclosed herein. The following claims particularly point out certain combinations and subcombinations regarded as novel and nonobvious. Inventions embodied in other combinations and subcombinations of features, functions, elements, and/or properties may be claimed in this application, in applications claiming priority from this application, or in related applications. Such claims, whether directed to a different invention or to the same invention, and whether broader, narrower, equal, or different in scope in comparison to the original claims, also are regarded as included within the subject matter of the inventions of the present disclosure.

Exemplary polypeptide constructs are detailed herein in Appendix A. While the exemplary polypeptides that contain Linker-2 (GPAGLYAQ, SEQ ID NO: 195), or Linker-3 (ALFKSSFP, SEQ ID NO: 198) or other cleavable linkers are disclosed in Appendix A, for each construct, the disclosed linker can be replaced with either Linker-2 (GPAGLYAQ, SEQ ID NO: 195), or Linker-3 (ALFKSSFP, SEQ ID NO: 198) or other cleavable linkers disclosed herein. For example construct ACP355 (IgG4_Fc(S228P)—X-CD25ecd_C213S-LX-IL2-LX Blocker_(Blocker=VHVL.F2.high.A02_Vh\VI_A46S; X=MMP14-1) can contain Linker-2, however it can be replaced with Linker-3. Alternatively, construct ACPT464 (IgG4_Fc(S228P)—X-IL2-LX-blocker_(Blocker=VHVL. F2.high. A02_Vh/VI_VH 105-VL43_disulfidel;X=CTSL 1-1) can contain Linker-3, however, it can be replaced with Linker-2.

The elements of the polypeptide constructs provided in Appendix A contain the abbreviations as follows: "L," "X," "LX," and "XL" each refer to a linker. "X" refers to a cleavable linker. "L" refers a linker that is optionally cleavable. When L is the only linker in a polypeptide, L is cleavable. "LX" or "XL" each refer to a cleavable linker with an extended non-cleavable sequence adjacent to it. Cleav. Lin. Also refers to a cleavable linker. Other abbreviations used include: "mIFNg" for mouse interferon gamma (IFNg); (5) "hAlbumin" for human serum albumin (HSA); and (6) "mAlbumin" indicates mouse serum albumin.

| Construct Name | Construct Description |
|---|---|
| ACP01 | (anti-HSA)-(cleav. link.)-mouse IFNγ-(cleav. link.)-(anti-HSA)-6xHis |
| ACP02 | (anti-HSA)-(cleav. link.)-mouse IFNγ-(cleav. link.)-mouse IFNγ-(cleav. link.)-(anti-HSA)-6xHis |
| ACP03 | (anti-HSA)-(cleav. link.)-mouse IFNγ-mouse IFNγ-(cleav. link.)-(anti-HSA)-6xHis |
| ACP50 | (anti-EpCAM)-(anti-HSA)-(cleav. link.)-mouse IFNγ-mouse IFNγ-(cleav. link.)-(anti-HSA)-6xHis |
| ACP51 | (anti-EpCAM)-Linker-(anti-HSA)-(cleav. link.)-mIFNγ-(cleav. link.)-(anti-HSA)-6xHis |
| ACP52 | (anti-HSA)-(cleav. link.)-mIFNγ-(cleav. link.)-(anti-HSA)-Linker-(anti-EpCAM)-6xHis |
| ACP53 | mAlbumin-(cleav. link.)-mIFNγ-(cleav. link.)-mAlbumin-6xHis |
| ACP54 | mAlbumin-(cleav. link.)-mIFNγ-Linker-mIFNγ-(cleav. link.)-mAlbumin-6xHis |
| ACP30 | (anti-HSA)-(cleav. link.)-mouse IFNγ-(cleav. link.)-(anti-HSA)-(cleav. link.)-mouse IFNγ-(cleav. link.)-(anti-HSA)-6xHis |
| ACP55 | (anti-HSA)-(cleav. link.)-mouse IFNγ-(cleav. link.)-(anti-HSA)-(cleav. link.)-mouse IFNγ-(cleav. link.)-(anti-HSA)-6xHis-C-tag |
| ACP56 | (anti-FOLR1)-Linker-(anti-HSA)-(cleav. link.)-mIFNγ-(cleav. link.)-(anti-HSA)-6xHis |
| ACP57 | (anti-HSA)-(cleav. link.)-mIFNγ-(cleav. link.)-(anti-HSA)-Linker-(anti-FOLR1)-6xHis |
| ACP58 | (anti-HSA)-(cleav. link.)-mIFNγ-(cleav. link.)-mIFNγ-(cleav. link.)-(anti-HSA)-Linker-(anti-EpCAM)-6xHis |
| ACP59 | (anti-FOLR1)-Linker-(anti-HSA)-(cleav. link.)-mIFNγ-(cleav. link.)-mIFNγ-(cleav. link.)-(anti-HSA)-6xHis |
| ACP60 | (anti-HSA)-(cleav. link.)-mIFNγ-(cleav. link.)-mIFNγ-(cleav. link.)-(anti-HSA)-Linker-(anti-FOLR1)-6xHis |
| ACP61 | (anti-HSA)-(cleav. link.)-mIFNγ-(cleav. link.)-mIFNγ-(cleav. link.)-(anti-HSA)-Linker-FN(CGS-2)-6xHis |
| ACP63 | anti-FN CGS-2 scFv (Vh/Vl)-6xHis |
| ACP69 | (anti-HSA)-(cleav. link.)-mouse IFNγ-(cleav. link.)-(anti-HSA)-(cleav. link.)-mouse IENγ |
| ACP70 | mouse IFNγ-(cleav. link.)-(anti-HSA)-(cleav. link.)-mouse IFNγ-(cleav. link.)-(anti-HSA) |
| ACP71 | mouse IFNγ-(cleav. link.)-mAlbumin-(cleav. link.)-mouse IFNγ-(cleav. link.)-mAlbumin |
| ACP72 | mAlbumin-(cleav. link.)-mouse IFNγ-(cleav. link.)-mAlbumin-(cleav. link.)-mouse IFNγ |
| ACP73 | mAlbumin-(cleav. link.)-mouse IFNγ-(cleav. link.)-mAlbumin-(cleav. link.)-mouse IFNγ-(cleav. link.)-mAlbumin |
| ACP74 | mAlbumin-(cleav. link.)-mouse IFNγ-(cleav. link.)-5mer linker-mAlbumin-5mer linker-(cleav. link.)-mouse IFNγ-(cleav. link.)-mAlbumin |
| ACP75 | mAlbumin-(cleav. link.)-mouse IFNγ-(cleav. link.)-10mer linker-mAlbumin-10mer linker-(cleav. link.)-mouse IFNγ-(cleav. link.)-mAlbumin |
| ACP78 | (anti-HSA)-Linker-mouse_IFNγ-Linker-(anti-HSA)-Linker-mouse IFNγ-Linker-(anti-HSA)_(non-cleavable_control) |
| ACP134 | Anti-HSA-X-mouse_IFNγ-X-anti-HSA-X-mouse_IFNγ-X-anti-HSA-L-anti-FOLR1 |
| ACP135 | Anti-FOLR1-L-HSA-X-mouse_IFNγ-X-HSA-X-mouse_IFNγ-X-HSA |
| ACP04 | human p40-murine p35-6xHis |
| ACP05 | human p40-human p35-6xHis |
| ACP34 | mouse p35-(Cleavable Linker)-mouse p40-6xHis |

-continued

| Construct Name | Construct Description |
| --- | --- |
| ACP35 | mouse p35-GS-(Cleavable Linker)-GS-mouse p40-6xHis |
| ACP36 | (anti-HSA)-(Cleav. Linker)-mouse p40-mouse p35-(Cleav. Linker)-(anti-HSA)-6xHis |
| ACP37 | (anti-EpCAM)-(anti-HSA)-(Cleav. Linker)-mouse p40-mouse p35-(Cleav. Linker)-(anti-HSA)-6xHis |
| ACP79 | (anti-EpCAM)-Linker-(anti-HSA)-(Cleavable Linker)-mIL12-(Cleavable Linker)-(Anti-HSA)-6xHis |
| ACP80 | (anti-HSA)-(Cleavable Linker)-mIL12-(Cleavable Linker)-(anti-HSA)-Linker-(anti-EpCAM)-6xHis |
| ACP06 | Blocker12-Linker-(Cleavable Linker)-human p40-Linker-mouse p35-(Cleavable Linker)-(anti-HSA)-6xHis |
| ACP07 | Blocker12-Linker-(Cleavable Linker)-human p40-Linker-mouse p35-(Cleavable Linker)-(anti-HSA)-Linker-(anti-FOLR1)-6xHis |
| ACP08 | (anti-FOLR1)-Linker-Blocker12-Linker-(Cleavable Linker)-human p40-Linker-mouse p35-(Cleavable Linker)-(anti-HSA)-6xHis |
| ACP09 | (anti-HSA)-Linker-Blocker12-Linker-(Cleavable Linker)-human p40-Linker-mouse p35-6xHis |
| ACP10 | (anti-HSA)-(Cleavable Linker)-human p40-L-mouse p35-(Cleavable Linker)-Linker-Blocker12-6xHis |
| ACP11 | hp40-Linker-mp35-(Cleavable Linker)-Linker-Blocker12-Linker-(anti-HSA)-6xHis |
| ACP91 | human_p40-Linker-mouse_p35-Linker-Linker-Blocker-Linker-(anti-HSA) (non-cleavable_control) |
| ACP136 | human p40-L-mouse p35-XL-Blocker |
| ACP138 | human_p40-L-mouse_p35-XL-Blocker-L-HSA-L-FOLR1 |
| ACP139 | FOLR1-L-human_p40-L-mouse_p35-XL-Blocker-L-HSA |
| ACP140 | FOLR1-X-human_p40-L-mouse_p35-XL-Blocker-L-HSA |
| ACP12 | (anti-EpCAM)-IL2-(cleav. link.)-(anti-HSA)-blocker-6xHis |
| ACP13 | (anti-EpCAM)-Blocker2-(anti-HSA)-(cleav. link.)-IL2-6xHis |
| ACP14 | Blocker2-Linker-(cleav. link.)-IL2- (cleav. link.)-(anti-HSA)-6xHis |
| ACP15 | Blocker2-Linker-(anti-HSA)-Linker-(cleav. link.)- IL2 -6xHis |
| ACP16 | IL2-(cleav. link.)-(anti-HSA)-Linker-(cleav. link.)-Blocker2-6xHis |
| ACP17 | (anti-EpCAM)-Linker-IL2-(cleav. link.)-(anti-HSA)-Linker-(cleav. link.)-Blocker2-6xHis |
| ACP18 | (anti-EpCAM)-Linker-IL2-(cleav. link.)-(anti-HSA)-Linker-vh(cleav. link.)vl-6xHis |
| ACP19 | IL2-(cleav. link.)-Linker-Blocker2-Linker-(anti-HSA)-Linker-(anti-EpCAM) -6xHis |
| ACP20 | IL2-(cleav. link.)-Blocker2-6xHis |
| ACP21 | IL2-(cleav. link.)-Linker-Blocker2-6xHis |
| ACP22 | IL2-(cleav. link.)-Linker-blocker-(cleav. link.)-(anti-HSA)-Linker-(anti-EpCAM)-6xHis |
| ACP23 | (anti-FOLR1)-(cleav. link.)-Blocker2-Linker-(cleav. link.)-(anti-HSA)-(cleav. link.)-IL2-6xHis |
| ACP24 | (Blocker2)-(cleav. link.)-(IL2)-6xHis |
| ACP25 | Blocker2-Linker-(cleav. link.)-IL2-6xHis |
| ACP26 | (anti-EpCAM)-Linker-IL2-(cleav. link.)-(anti-HSA)-Linker-blocker(NARA1 Vh/Vl) |
| ACP27 | (anti-EpCAM)-Linker-IL2-(cleav. link.)-(anti-HSA)-Linker-blocker(NARA1 Vl/Vh) |
| ACP28 | IL2-(cleav. link.)-Linker-Blocker2-(NARA1 Vh/Vl)-Linker-(anti-HSA)-Linker-(anti-EpCAM) |
| ACP29 | IL2-(cleav. link.)-Linker-Blocker2-(NARA1 Vl/Vh)-Linker-(anti-HSA)-Linker-(anti-EpCAM) |
| ACP38 | IL2-(cleav. link.)-blocker-(anti-HSA)-(anti-EpCAM)-6xHis |
| ACP39 | (anti-EpCAM)-(cleav. link.)-(anti-HSA)-(cleav. link.)-Blocker2-(cleav. link.)-IL-2-6xHis |
| ACP40 | CD25ecd-Linker-(cleav. link.)-IL2-6xHis |
| ACP41 | IL2-(cleav. link.)-Linker-CD25ecd-6xHis |
| ACP42 | (anti-HSA)-Linker-CD25ecd-Linker-(cleav. link.)-IL2-6xHis |
| ACP43 | IL2-(cleav. link.)-Linker-CD25ecd-Linker-(anti-HSA)-6xHis |
| ACP44 | IL2-(cleav. link.)-Linker-CD25ecd-(cleav. link.)-(anti-HSA)-6xHis |
| ACP45 | (anti-HSA)-(cleav. link.)-Blocker2-Linker-(cleav. link.)-IL2-6xHis |
| ACP46 | IL2-(cleav. link.)-linkerL-vh(cleav. link.)vl-Linker-(anti-HSA)-L-(anti-EpCAM)-6xHis |
| ACP47 | (anti-EpCAM)-Linker-IL2-(Cleavable Linker)-(anti-HSA)-Linker-Blocker2-6xHis |
| ACP48 | IL2-(cleav. link.)-Blocker2-Linker-(anti-HSA)-6xHis |
| ACP49 | IL2-(cleav. link.)-Linker-Blocker2-Linker-(anti-HSA)-6xHis |
| ACP92 | (anti-HSA)-(16mer Cleav. Link.)-IL2-(16mer Cleav. Link.)-(anti-HSA)-6XHis |
| ACP93 | (anti-EpCAM)-(anti-HSA)-(anti-EpCAM)-Blocker2-(cleav. link.)-IL2-6xHis |
| ACP94 | (anti-EpCAM)-(anti-HSA)-Blocker2-(cleav. link.)-IL2-6xHis |
| ACP95 | (anti-EpCAM)-(anti-HSA)-(cleav. link.)-IL2-6xHis |
| ACP96 | (anti-EpCAM)-(16mer cleav. link.)-IL2-(16mer cleav. link.)-(anti-HSA) |
| ACP38 | IL2-(cleav. link.)-blocker-(anti-HSA)-(anti-EpCAM)-6xHis |
| ACP97 | (anti-EpCAM)-(anti-HSA)-(cleav. link.)-IL2-(cleav. link.)-(anti-HSA)-6xHis |
| ACP99 | (anti-EpCAM)-Linker-IL2-(cleav. link.)-(anti-HSA)-6xHis |
| ACP100 | (anti-EpCAM)-Linker-IL2-6xHis |
| ACP101 | IL2-(cleav. link.)-(anti-HSA)-6xHis |
| ACP102 | (anti-EpCAM)-(cleav. link.)-IL2-(cleav. link.)-(anti-HSA)-Linker-blocker-6xHis |
| ACP103 | IL2-(cleav. link.)-Linker-Blocker2-Linker-(anti-HSA)-Linker-(antiI-FOLR1)-6xHis |
| ACP104 | (anti-FOLR1)-IL2-(cleav. link.)-(anti-HSA)-Linker-Blocker2-6xHis |
| ACP105 | Blocker2-Linker-(cleav. link.)-IL2-(cleav. link.)-(anti-HSA)-Linker-(anti-FOLR1)-6xHis |

-continued

| Construct Name | Construct Description |
| --- | --- |
| ACP106 | (anti-FOLR1)-Linker-(anti-HSA)-(cleav. link.)-blocker-Linker-(cleav. link.)-IL2 -6xHis |
| ACP107 | Blocker2-Linker-(anti-HSA)-(cleav. link.)-IL2-Linker-(anti-FOLR1)-6xHis |
| ACP108 | (anti-EpCAM)-IL2-(Dually cleav. link.)-(anti-HSA)-Linker-blocker-6xHis |
| ACP117 | anti-FN CGS-2 scFv (Vh/Vl)-6xHis |
| ACP118 | NARA1 Vh/Vl non-cleavable |
| ACP119 | NARA1 Vh/Vl cleavable |
| ACP120 | NARA1 Vl/Vh non-cleavable |
| ACP121 | NARA1 Vl/Vh cleavable |
| ACP124 | IL2-Linker-(anti-HSA)-Linker-Linker-blocker_(non-cleavable_control) |
| ACP132 | IL2-L-HSA |
| ACP141 | IL2-L-hAlb |
| ACP142 | IL2-X-hAlb |
| ACP144 | IL2-X-HSA-LX-blocker-L-FOLR1 |
| ACP145 | FOLR1-L-IL2-X-HSA-LX-blocker |
| ACP146 | FOLR1-X-IL2-X-HSA-LX-blocker |
| ACP133 | IL-2-6x His |
| ACP147 | IL2-X-HSA-LX-blocker-L-TAA |
| ACP148 | TAA-L-IL2-X-HSA-LX-blocker |
| ACP149 | TAA-X-IL2-X-HSA-LX-blocker |
| ACP31 | (anti-HSA)-(cleav. link.)-mIFNa1-(cleav. link.)-(anti-HSA) |
| ACP32 | (anti-HSA)-(cleav. link.)-mIFNa1(N + C trunc)-(cleav. link.)-(anti-HSA) |
| ACP33 | (anti-HSA)-(cleav. link.)-mIFNa1(C trunc)-(cleav. link.)-(anti-HSA) |
| ACP131 | mIFNa1 |
| ACP125 | HSA-X-mIFNa1 |
| ACP126 | mIFNa1-X-HSA |
| ACP127 | mAlb-X-mIFNa1-X-mAlb |
| ACP128 | mAlb-X-mIFNa1 |
| ACP129 | mIFNa1-X-mAlb |
| ACP150 | FOLR1-L-HSA-X-mIFNa1-X-HSA |
| ACP151 | FOLR1-L-HSA-X-mIFNa1-X-HSA-L-FOLR1 |
| ACP152 | HSA-L-mIFNa1-L-HSA_(non-cleavable_control) |
| ACP203 | HSA-X-mIFNa1-X-HSA_(X = MMP14-1) |
| ACP204 | HSA-X-mIFNa1-X-HSA_(X = CTSL1-1) |
| ACP205 | HSA-X-mIFNa1-X-HSA_(X = ADAM17-2) |
| ACP206 | HSA-X-Human_IFNA2b-X-HSA_(X = MMP14-1) |
| ACP207 | HSA-X-Human_IFNA2b-X-HSA_(X = CTSL1-1) |
| ACP208 | HSA-X-Human_IFNA2b-X-HSA_(X = ADAM17-2) |
| ACP336 | IL2-X-anti-HSA-LX-blocker_(Blocker = VHVL.F2.high.A02_Vh-X-Vl_A46S; X = MMP14-1) |
| ACP337 | IL2-X-anti-HSA-LX-blocker_(Blocker = VHVL.F2.high.A02_Vh/Vl_A46S; X = MMP14-1) |
| ACP338 | IL2-X-anti-HSA-LX-blocker_(Blocker = VHVL.F2.high.F03_Vh-X-Vl; X = MMP14-1) |
| ACP339 | IL2-X-anti-HSA-LX-blocker_(Blocker = VHVL.F2.high.F03_Vh/Vl; X = MMP14-1) |
| ACP340 | IL2-X-anti-HSA-LX-blocker_(Blocker = Hu2TOW91_B; X = MMP14-1) |
| ACP341 | IL2-X-anti-HSA-LX-blocker_(Blocker = Hu3TOW85_A; X = MMP14-1) |
| ACP342 | CD25ecd_C213S-LX-IL2-X-anti-HSA-LX-blocker_(Blocker = VHVL.F2.high.A02_Vh-X-Vl_A46S; X = MMP14-1) |
| ACP343 | CD25ecd_C213S-LX-IL2-X-anti-HSA-LX-blocker_(Blocker = VHVL.F2.high.A02_Vh/Vl_A46S; X = MMP14-1) |
| ACP344 | CD25ecd_C213S-LX-IL2-X-anti-HSA-LX-blocker_(Blocker = VHVL.F2.high.F03_Vh-X-Vl; X = MMP14-1) |
| ACP345 | CD25ecd_C213S-LX-IL2-X-anti-HSA-LX-blocker_(Blocker = VHVL.F2.high.F03_Vh/Vl; X = MMP14-1) |
| ACP346 | CD25ecd_C213S-LX-IL2-X-anti-HSA-LX-blocker_(Blocker = Hu2TOW91_B; X = MMP14-1) |
| ACP347 | CD25ecd_C213S-LX-IL2-X-anti-HSA-LX-blocker_(Blocker = Hu3TOW85_A; X = MMP14-1) |
| ACP348 | IgG4_Fc(S228P)-X-IL2-LX-Blocker_(Blocker = VHVL.F2.high.A02_Vh-X-Vl_A46S; X = MMP14-1) |
| ACP349 | IgG4_Fc(S228P)-X-IL2-LX-Blocker_(Blocker = VHVL.F2.high.A02_Vh\Vl_A46S; X = MMP14-1) |
| ACP350 | IgG4_Fc(S228P)-X-IL2-LX-Blocker_(Blocker = VHVL.F2.high.F03_Vh-X-Vl; X = MMP14-1) |
| ACP351 | IgG4_Fc(S228P)-X-IL2-LX-Blocker_(Blocker = VHVL.F2.high.F03_Vh\Vl; X = MMP14-1) |
| ACP352 | IgG4_Fc(S228P)-X-IL2-LX-Blocker_(Blocker = Hu2TOW91_B; X = MMP14-1) |
| ACP353 | IgG4_Fc(S228P)-X-IL2-LX-Blocker_(Blocker = Hu3TOW85_A; X = MMP14-1) |
| ACP354 | IgG4_Fc(S228P)-X-CD25ecd_C213S-LX-IL2-LX-Blocker_(Blocker = VHVL.F2.high.A02_Vh-X-Vl_A46S; X = MMP14-1) |
| ACP355 | IgG4_Fc(S228P)-X-CD25ecd_C213S-LX-IL2-LX-Blocker_(Blocker = VHVL.F2.high.A02_Vh\Vl_A46S; X = MMP14-1) |
| ACP356 | IgG4_Fc(S228P)-X-CD25ecd_C213S-LX-IL2-LX-Blocker_(Blocker = VHVL.F2.high.F03_Vh-X-Vl; X = MMP14-1) |
| ACP357 | IgG4_Fc(S228P)-X-CD25ecd_C213S-LX-IL2-LX-Blocker_(Blocker = VHVL.F2.high.F03_Vh\Vl; X = MMP14-1) |

-continued

| Construct Name | Construct Description |
|---|---|
| ACP358 | IgG4_Fc(S228P)-X-CD25ecd_C213S-LX-IL2-LX-Blocker_(Blocker = Hu2TOW91_B; X = MMP14-1) |
| ACP359 | IgG4_Fc(S228P)-X-CD25ecd_C213S-LX-IL2-LX-Blocker_(Blocker = Hu3TOW85_A; X = MMP14-1) |
| ACP360 | MT204_Vh/Vl_3xG4S_A46S |
| ACP361 | MT204_Vh-X-Vl_X = MMP14-1 |
| ACP362 | MT204_Vh-X-Vl_X = MMP14-1, _A46S |
| ACP365 | VHVL.F2.high.A02_Vh-X-Vl_X = MMP14-1 |
| ACP366 | VHVL.F2.high.A02_Vh-X-Vl_X = MMP14-1, _A46S |
| ACP368 | VHVL.F2.high.F03_Vh-X-Vl_X = MMP14-1 |
| ACP371 | IL2-X-anti-HSA-LX-blocker_(Blocker = MT204_Vh/Vl_VH44-VL100_disulfide; X = MMP14-1) |
| ACP372 | IL2-X-anti-HSA-LX-blocker_(Blocker = MT204_Vh/Vl_VH105-VL43_disulfide; X = MMP14-1) |
| ACP373 | IL2-X-anti-HSA-LX-blocker_(Blocker = VHVL.F2.high.A02_Vh/Vl_VH44-VL100_disulfide; X = MMP14-1) |
| ACP374 | IL2-X-anti-HSA-LX-blocker_(Blocker = VHVL.F2.high.A02_Vh/Vl_VH105-VL43_disulfide; X = MMP14-1) |
| ACP375 | IL2-X-anti-HSA-LX-blocker_(Blocker = VHVL.F2.high.F03_Vh/Vl_VH44-VL100_disulfide; X = MMP14-1) |
| ACP376 | IL2-X-anti-HSA-LX-blocker_(Blocker = VHVL.F2.high.F03_Vh/Vl_VH105-VL43_disulfideX = MMP14-1) |
| ACP377 | IL2-X-anti-HSA-LX-blocker_(Blocker = Hu2TOW91_A; X = MMP14-1) |
| ACP378 | IL2-X-anti-HSA-LX-Heavy_blocker_Fab_(Blocker = MT204_VH-CH1; X = MMP14-1) |
| ACP379 | IgG4_Fc(S228P)-X-IL2-LX-Heavy_blocker_Fab_(Blocker = MT204_VH-CH1; X = MMP14-1) |
| ACP383 | IgG4_Fc(S228P)-X-IL2-LX-blocker_(Blocker = MT204_Vh/Vl_VH44-VL100_disulfide; X = MMP14-1) |
| ACP384 | IgG4_Fc(S228P)-X-IL2-LX-blocker_(Blocker = MT204_Vh/Vl_VH105-VL43_disulfide; X = MMP14-1) |
| ACP385 | IgG4_Fc(S228P)-X-IL2-LX-blocker_(Blocker = VHVL.F2.high.A02_Vh/Vl_VH44-VL100_disulfide; X = MMP14-1) |
| ACP386 | IgG4_Fc(S228P)-X-IL2-LX-blocker_(Blocker = VHVL.F2.high.A02_Vh/Vl_VH105-VL43_disulfide; X = MMP14-1) |
| ACP387 | IgG4_Fc(S228P)-X-IL2-LX-blocker_(Blocker = VHVL.F2.high.F03_Vh/Vl_VH44-VL100_disulfide; X = MMP14-1) |
| ACP388 | IgG4_Fc(S228P)-X-IL2-LX-blocker_(Blocker = VHVL.F2.high.F03_Vh/Vl_VH105-VL43_disulfide; X = MMP14-1) |
| ACP389 | IgG4_Fc(S228P)-X-IL2-LX-blocker_(Blocker = Hu2TOW91_A; X = MMP14-1) |
| ACP390 | IL2-X-anti-HSA-LX-blocker_(Blocker = VHVL.F2.high.A02_Vh/Vl_A46S_VH44-VL100_disulfide; X = MMP14-1) |
| ACP391 | IgG4_Fc(S228P)-X-IL2-LX-blocker_(Blocker = VHVL.F2.high.A02_Vh/Vl_A46S_VH44-VL100_disulfide; X = MMP14-1) |
| ACP392 | IL2-XL-CD25ecd_C213S-X-HSA-LX-blocker_(Blocker = VHVL.F2.high.A02_Vh_G44C_Vl_A46S_G100C; X = MMP14-1) |
| ACP393 | IL2-XL-CD25ecd_C213S-X-HSA-LX-blocker_(Blocker = VHVL.F2.high.A02_Vh_Q105C_Vl_A43C; X = MMP14-1) |
| ACP394 | IL2-XL-CD25ecd_C213S-X-HSA-LX-blocker_(Blocker = VHVL.F2.high.F03_Vh_G44C_Vl_G100C; X = MMP14-1) |
| ACP395 | IL2-XL-CD25ecd_C213S-X-HSA-LX-blocker_(Blocker = VHVL.F2.high.F03_Vh_Q105C_Vl_A43C; X = MMP14-1) |
| ACP396 | IL2-XL-CD25ecd_C213S-X-HSA-LX-blocker_(Blocker = Hu2TOW91_A; X = MMP14-1) |
| ACP397 | IL2-XL-CD25ecd_C213S-X-HSA-LX-blocker_(Blocker = Hu2TOW91_B; X = MMP14-1) |
| ACP398 | IL2-XL-CD25ecd_C213S-X-HSA-LX-Heavy_blocker_Fab_(Blocker = MT204_VH-CH1; X = MMP14-1) |
| ACP399 | Blocker-XL-HSA-X-IL2(Nterm-41)-X-HSA_(Blocker = VHVL.F2.high.A02_Vh_G44C_Vl_A46S_G100C; X = MMP14-1) |
| ACP400 | Blocker-XL-HSA-X-IL2(Nterm-41)-X-HSA_(Blocker = VHVL.F2.high.A02_Vh_Q105C_Vl_A43C; X = MMP14-1) |
| ACP401 | Blocker-XL-HSA-X-IL2(Nterm-41)-X-HSA_(Blocker = VHVL.F2.high.F03_Vh_G44C_Vl_G100C; X = MMP14-1) |
| ACP402 | Blocker-XL-HSA-X-IL2(Nterm-41)-X-HSA_(Blocker = VHVL.F2.high.F03_Vh_Q105C_Vl_A43C; X = MMP14-1) |
| ACP403 | Blocker-XL-HSA-X-IL2(Nterm-41)-X-HSA_(Blocker = Hu2TOW91_A; X = MMP14-1) |
| ACP404 | Blocker-XL-HSA-X-IL2(Nterm-41)-X-HSA_(Blocker = Hu2TOW91_B; X = MMP14-1) |
| ACP405 | Heavy_Blocker_Fab-XL-HSA-X-IL2(Nterm-41)-X-HSA_(Blocker = MT204_VH-CH1; X = MMP14-1) |
| ACP406 | mIgG1_Fc(S228P)-X-IL2-LX-Heavy_blocker_Fab_(Blocker = MT204_VH-CH1; X = MMP14-1) |
| ACP407 | mIgG1_Fc(S228P)-X-IL2-LX-blocker_(Blocker = VHVL.F2.high.A02_Vh/Vl_VH44-VL100_disulfide; X = MMP14-1) |
| ACP408 | mIgG1_Fc(S228P)-X-IL2-LX-blocker_(Blocker = VHVL.F2.high.A02_Vh/Vl_A46S_VH44-VL100_disulfide; X = MMP14-1) |

-continued

| Construct Name | Construct Description |
| --- | --- |
| ACP409 | mIgG1_Fc(S228P)-X-IL2-LX-blocker_(Blocker = VHVL.F2.high.A02_Vh/Vl_VH105-VL43_disulfidel; X = MMP14-1) |
| ACP410 | mIgG1_Fc(S228P)-X-IL2-LX-blocker_(Blocker = VHVL.F2.high.F03_Vh/Vl_VH44-VL100_disulfidel; X = MMP14-1) |
| ACP411 | mIgG1_Fc(S228P)-X-IL2-LX-blocker_(Blocker = VHVL.F2.high.F03_Vh/Vl_VH105-VL43_disulfidel; X = MMP14-1) |
| ACP412 | mIgG1_Fc(S228P)-X-IL2-LX-blocker_(Blocker = Hu2TOW91_A; X = MMP14-1) |
| ACP415 | IL2-XL-blocker-L-CD25_213S-X-HSA_Blocker = VHVL.F2.high.A02_Vh_G44C_Vl_A46S_G100C; X = MMP14-1) |
| ACP416 | IL2-XL-blocker-L-CD25_213S-X-HSA_(Blocker = VHVL.F2.high.A02_Vh_Q105C_Vl_A43C; X = MMP14-1) |
| ACP417 | IL2-XL-blocker-L-CD25_213S-X-HSA_(Blocker = VHVL.F2.high.F03_Vh_G44C_Vl_G100C; X = MMP14-1) |
| ACP418 | IL2-XL-blocker-L-CD25_213S-X-HSA_(Blocker = VHVL.F2.high.F03_Vh_Q105C_Vl_A43C; X = MMP14-1) |
| ACP419 | IL2-XL-blocker-L-CD25_213S-X-HSA_(Blocker = Hu2TOW91A; X = MMP14-1) |
| ACP420 | IL2-XL-blocker-L-CD25_213S-X-HSA_(Blocker = Hu2TOW91B; X = MMP14-1) |
| ACP421 | HSA-X-blocker-L-CD25_213S-LX-IL2_(Blocker = VHVL.F2.high.A02_Vh_G44C_Vl_A46S_G100C; X = MMP14-1) |
| ACP422 | HSA-X-blocker-L-CD25_213S-LX-IL2_(Blocker = VHVL.F2.high.A02_Vh_Q105C_Vl_A43C; X = MMP14-1) |
| ACP423 | HSA-X-blocker-L-CD25_213S-LX-IL2_(Blocker = VHVL.F2.high.F03_Vh_G44C_Vl_G100C; X = MMP14-1) |
| ACP424 | HSA-X-blocker-L-CD25_213S-LX-IL2_(Blocker = VHVL.F2.high.F03_Vh_Q105C_Vl_A43C; X = MMP14-1) |
| ACP425 | HSA-X-blocker-L-CD25_213S-LX-IL2_(Blocker = Hu2TOW91_A; X = MMP14-1) |
| ACP426 | HSA-X-blocker-L-CD25_213S-LX-IL2_(Blocker = Hu2TOW91B; X = MMP14-1) |
| ACP427 | IL2-X-anti-HSA-LX-Blocker1-L-Blocker2_(Blocker1 = VHVL.F2.high.A02_Vh_G44C_Vl_A46S_G100C, Blocker2 = Hu2TOW91_A; X = MMP14-1) |
| ACP428 | IL2-X-anti-HSA-LX-Blocker1-L-Blocker2_(Blocker1 = VHVL.F2.high.A02_Vh_Q105C_Vl_A43C, Blocker2 = Hu2TOW91_A; X = MMP14-1) |
| ACP429 | IL2-X-anti-HSA-LX-Blocker1-L-Blocker2_(Blocker1 = VHVL.F2.high.F03_Vh_G44C_Vl_G100C, Blocker2 = Hu2TOW91_A; X = MMP14-1) |
| ACP430 | IL2-X-anti-HSA-LX-Blocker1-L-Blocker2_(Blocker1 = VHVL.F2.high.F03_Vh_Q105C_Vl_A43C, Blocker2 = Hu2TOW91_A; X = MMP14-1) |
| ACP431 | IL2-X-anti-HSA-LX-Blocker1-L-Blocker2_(Blocker1 = VHVL.F2.high.A02_Vh_G44C_Vl_A46S_G100C, Blocker2 = Hu2TOW91_B; X = MMP14-1) |
| ACP432 | IL2-X-anti-HSA-LX-Blocker1-L-Blocker2_(Blocker1 = VHVL.F2.high.A02_Vh_Q105C_Vl_A43C, Blocker2 = Hu2TOW91_B; X = MMP14-1) |
| ACP433 | IL2-X-anti-HSA-LX-Blocker1-L-Blocker2_(Blocker1 = VHVL.F2.high.F03_Vh_G44C_Vl_G100C, Blocker2 = Hu2TOW91_B; X = MMP14-1) |
| ACP434 | IL2-X-anti-HSA-LX-Blocker1-L-Blocker2_(Blocker1 = VHVL.F2.high.F03_Vh_Q105C_Vl_A43C, Blocker2 = Hu2TOW91_B; X = MMP14-1) |
| ACP439 | IL2-X-anti-HSA-LX-blocker_(Blocker = VHVL.F2.high.C07_Vh/Vl; X = MMP14-1) |
| ACP440 | IL2-X-anti-HSA-LX-blocker_(Blocker = VHVL.F2.high.C07_Vh/Vl_A46S; X = MMP14-1) |
| ACP441 | IL2-X-anti-HSA-LX-blocker_(Blocker = VHVL.F2.high.C07_Vh/Vl_A46L; X = MMP14-1) |
| ACP442 | IL2-X-anti-HSA-LX-blocker_(Blocker = VHVL.F2.high.C07_Vh/Vl_A46S_VH44-VL100_disulfide; X = MMP14-1) |
| ACP443 | IL2-X-anti-HSA-LX-blocker_(Blocker = VHVL.F2.high.C07_Vh/Vl_A46L_VH44-VL100_disulfide; X = MMP14-1) |
| ACP444 | IL2-X-anti-HSA-LX-blocker_(Blocker = VHVL.F2.high.C07_Vh/Vl_VH105-VL43_disulfide; X = MMP14-1) |
| ACP445 | IL2-X-anti-HSA-LX-blocker_(Blocker = VHVL.F2.high.A02_Vh-X-Vl_A46L; X = MMP14-1) |
| ACP446 | IL2-X-anti-HSA-LX-blocker_(Blocker = VHVL.F2.high.A02_Vh/Vl_A46L; X = MMP14-1) |
| ACP447 | IL2-X-anti-HSA-LX-blocker_(Blocker = VHVL.F2.high.A02_Vh/Vl_A46L_VH44-VL100_disulfide; X = MMP14-1) |
| ACP451 | IL2-X-anti-HSA-LX-blocker_(Blocker = VHVL.F2.high.A02_Vh/Vl_A46S; X = CTSL1-1) |
| ACP452 | IL2-X-anti-HSA-LX-blocker_(Blocker = VHVL.F2.high.F03_Vh/Vl; X = CTSL1-1) |
| ACP453 | IL2-X-anti-HSA-LX-blocker_(Blocker = VHVL.F2.high.A02_Vh/Vl_A46S_VH44-VL100_disulfide; X = CTSL1-1) |
| ACP454 | IL2-X-anti-HSA-LX-blocker_(Blocker = VHVL.F2.high.A02_Vh/Vl_VH105-VL43_disulfidel; X = CTSL1-1) |
| ACP455 | IL2-X-anti-HSA-LX-blocker_(Blocker = VHVL.F2.high.F03_Vh/Vl_VH44-VL100_disulfide; X = CTSL1-1) |

-continued

| Construct Name | Construct Description |
|---|---|
| ACP456 | IL2-X-anti-HSA-LX-blocker_(Blocker = VHVL.F2.high.F03_Vh/Vl_VH105-VL43_disulfideX = CTSL1-1) |
| ACP457 | IL2-X-anti-HSA-LX-Heavy_blocker_Fab_(Blocker = MT204_VH-CH1; X = CTSL1-1) |
| ACP458 | IgG4_Fc(S228P)-X-IL2-LX-Heavy_blocker_Fab_(Blocker = MT204_VH-CH1; X = CTSL1-1) |
| ACP459 | IgG4_Fc(S228P)-X-IL2-LX-Blocker_(Blocker = VHVL.F2.high.A02_Vh\Vl_A46S; X = CTSL1-1) |
| ACP460 | IgG4_Fc(S228P)-X-IL2-LX-Blocker_(Blocker = VHVL.F2.high.F03_Vh\Vl; X = CTSL1-1) |
| ACP461 | IgG4_Fc(S228P)-X-IL2-LX-blocker_(Blocker = VHVL.F2.high.A02_Vh/Vl_A46S_VH44-VL100_disulfide; X = CTSL1-1) |
| ACP462 | IgG4_Fc(S228P)-X-IL2-LX-blocker_(Blocker = VHVL.F2.high.A02_Vh/Vl_VH105-VL43_disulfidel; X = CTSL1-1) |
| ACP463 | IgG4_Fc(S228P)-X-IL2-LX-blocker_(Blocker = VHVL.F2.high.F03_Vh/Vl_VH44-VL100_disulfidel; X = CTSL1-1) |
| ACP464 | IgG4_Fc(S228P)-X-IL2-LX-blocker_(Blocker = VHVL.F2.high.F03_Vh/Vl_VH105-VL43_disulfidel; X = CTSL1-1) |
| ACP465 | mIgG1_Fc-X-IL2-LX-Blocker_(Blocker = VHVL.F2.high.A02_Vh\Vl_A46S; X = CTSL1-1) |
| ACP466 | mIgG1_Fc-X-IL2-LX-Blocker_(Blocker = VHVL.F2.high.F03_Vh\Vl; X = CTSL1-1) |
| ACP467 | mIgG1_Fc-X-IL2-LX-blocker_(Blocker = VHVL.F2.high.A02_Vh/Vl_A46S_VH44-VL100_disulfide; X = CTSL1-1) |
| ACP468 | mIgG1_Fc-X-IL2-LX-blocker_(Blocker = VHVL.F2.high.A02_Vh/Vl_VH105-VL43_disulfidel; X = CTSL1-1) |
| ACP469 | mIgG1_Fc-X-IL2-LX-blocker_(Blocker = VHVL.F2.high.F03_Vh/Vl_VH44-VL100_disulfidel; X = CTSL1-1) |
| ACP470 | mIgG1_Fc-X-IL2-LX-blocker_(Blocker = VHVL.F2.high.F03_Vh/Vl_VH105-VL43_disulfidel; X = CTSL1-1) |
| ACP471 | mIgG1_Fc-X-IL2-LX-Heavy_blocker_Fab_(Blocker = MT204_VH-CH1; X = CTSL1-1) |

APPENDIX B

Sequences

| SEQ ID NO. | Name | Sequence |
|---|---|---|
| 1 | Human IL-2 | MYRMQLLSCI ALSLALVTNS APTSSSTKKT QLQLEHLLLD LQMILNGINN YKNPKLTRML TFKFYMPKKA TELKHLQCLE EELKPLEEVL NLAQSKNFHL RPRDLISNIN VIVLELKGSE TTFMCEYADE TATIVEFLNR WITFCQSIISTLT |
| 2 | Human serum albumin | MKWVTFISLL FLFSSAYSRG VFRRDAHKSE VAHRFKDLGE ENFKALVLIA FAQYLQQCPF EDHVKLVNEV TEFAKTCVAD ESAENCDKSL HTLFGDKLCT VATLRETYGE MADCCAKQEP ERNECFLQHK DDNPNLPRLV RPEVDVMCTA FHDNEETFLK KYLYEIARRH PYFYAPELLF FAKRYKAAFT ECCQAADKAA CLLPKLDELR DEGKASSAKQ GLKCASLQKF GERAFKAWAV ARLSQRFPKA EFAEVSKLVT DLTKVHTECC HGDLLECADD RADLAKYICE NQDSISSKLK ECCEKPLLEK SHCIAEVEND EMPADLPSLA ADFVGSKDVC KNYAEAKDVF LGMFLYEYAR RHPDYSVVLL LRLAKTYETT LEKCCAAADP HECYAKVFDE FKPLVEEPQN LIKQNCELFE QLGEYKFQNA LLVRYTKKVP QVSTPTLVEV SRNLGKVGSK CCKHPEAKRM PCAEDCLSVF LNQLCVLHEK TPVSDRVTKC CTESLVNGRPCFSALEVDETYVPKEFNAETFTFHADICTLSEKERQIKKQTALV ELVKHK PKATKEQLKAVMDDFAAFVEKCCKADDKETCFAEEGKKLVAASQAAL GL |
| 45 | ACP12 (IL2 conjugate) | QVQLQESGGGLVQAGGSLRLSCAASGRIFSIDIMSWYRQAPGKQRELVARITRG GTISYDDSVKGRFTISRDNAKNTVYLQMNSLKPEDTGVYYCNALYGTDYWGKGT QVTVSSggggsggggsggggsaptssstkktqlqlehllldlqmilnginnykn pkltrmltfkfympkkatelkhlqcleeelkpleevlnlaqsknfhlrprdlis ninvivlelkgsettfmceyadetativeflnrwitfcqsiistltSGGPGPAG MKGLPGSEVQLVESGGGLVQPGNSLRLSCAASGFTFSKFGMSWVRQAPGKGLEW VSSISGSGRDTLYAESVKGRFTISRDNAKTTLYLQMNSLRPEDTAVYYCTIGGS LSVSSQGTLVTVSSggggsggggsggggsEVQLVESGGGLVQPGGSLRLSCAAS GFTFSSYTLAWVRQAPGKGLEWVAAIDSSSYTYSPDTVRGRFTISRDNASLY LQMNSLRAEDTAVYYCARDSNWDALDYWGQGTTVTVSSGGGGSGGGGSGGGGSD IQMTQSPSSLSASVGDRVTITCKASQNVGTNVGWYQQKPGKAPKALIYSASFRY SGVPSRFSGSGSGTDFTLTISSLQPEDFATYYCQQYYTYPYTFGGGTKVEIKHH HHHH |

APPENDIX B-continued

Sequences

| SEQ ID NO. | Name | Sequence |
|---|---|---|
| 46 | ACP13 (IL2 conjugate) | QVQLQESGGGLVQAGGSLRLSCAASGRIFSIDIMSWYRQAPGKQRELVARITRG GTISYDDSVKGRFTISRDNAKNTVYLQMNSLKPEDTGVYYCNALYGTDYWGKGT QVTVSSggggsggggsggggsEVQLVESGGGLVQPGGSLRLSCAASGFTFSSYT LAWVRQAPGKGLEWVAAIDSSSYTYSPDTVRGRFTISRDNAKNSLYLQMNSLRA EDTAVYYCARDSNWDALDYWGQGTTVTVSSGGGGSGGGGSGGGGSDIQMTQSPS SLSASVGDRVTITCKASQNVGTNVGWYQQKPGKAPKALIYSASFRYSGVPSRFS GSGSGTDFTLTISSLQPEDFATYYCQQYYTYPYTFGGGTKVEIKggggsggggs ggggsEVQLVESGGGLVQPGNSLRLSCAASGFTFSKFGMSWVRQAPGKGLEWVS SISGSGRDTLYAESVKGRFTISRDNAKTTLYLQMNSLRPEDTAVYYCTIGGSLS VSSQGTLVTVSSGGGPGPAGMKGLPGSaptssstkktqlqlehllldlqmilng innyknpkltrmltfkfympkkatelkhlqcleeelkpleevlnlaqsknfhlr prdlisninvivlelkgsettfmceyadetativeflnrwitfcqsiistltHH HHHH |
| 47 | ACP14 (IL2 conjugate) | EVQLVESGGGLVQPGGSLRLSCAASGFTFSSYTLAWVRQAPGKGLEWVAAIDSS SYTYSPDTVRGRFTISRDNAKNSLYLQMNSLRYAEDTAVYCARDSNWDALDYWG QGTTVTVSSGGGGSGGGGSGGGGSDIQMTQSPSSLSASVGDRVTITCKASQNVG TNVGWYQQKPGKAPKALIYSASFRYSGVPSRFSGSGSGTDFTLTISSLQPEDFA TYYCQQYYTYPYTFGGGTKVEIKggggsggggsggggsggggsggggsggggsS GGPGPAGMKGLPGSaptssstkktqlqlehllldlqmilnginnyfmceknpkl trmltfkfympkkatelkhlqcleeelkpleevlnlaqsknfhlrprdlisnin vivlelkgsettfmceyadetativeflnrwitfcqsiistltSGGPGPAGMKG LPGSEVQLVESGGGLVQPGNSLRLSCAASGFTFSKFGMSWVRQAPGKGLEWVSS ISGSGRDTLYAESVKGRFTISRDNAKTTLYLQMNSLRPEDTAVYYCTIGGSLSV SSQGTLVTVSSHHHHHH |
| 48 | ACP15 (IL2 conjugate) | EVQLVESGGGLVQPGGSLRLSCAASGFTFSSYTLAWVRQAPGKGLEWVAAIDSS SYTYSPDTVRGRFTISRDNAKNSLYLQMNSLRAEDTAVYYCARDSNWDALDYWG QGTTVTVSSGGGGSGGGGSGGGGSDIQMTQSPSSLSASVGDRVTITCKASQNVG TNVGWYQQKPGKAPKALIYSASFRYSGVPSRFSGSGSGTDFTLTISSLQPEDFA TYYCQQYYTYPYTFGGGTKVEIKggggsggggsggggsggggsggggsggggsE VQLVESGGGLVQPGNSLRLSCAASGFTFSKFGMSWVRQAPGKGLEWVSSISGSG RDTLYAESVKGRFTISRDNAKTTLYLQMNSLRPEDTAVYYCTIGGSLSVSSQGT LVTVSSggggsggggsggggsSGGPGPAGMKGLPGSaptssstkktqlqlehll ldlqmilnginnyknpkltrmltfkfympkkatelkhlqcleeelkpleevlnl aqsknfhlrprdlisninvivlelkgsettfmceyadetativeflnrwitfcq siistltHHHHHH |
| 49 | ACP16 (IL2 conjugate) | aptssstkktqlqlehllldlqmilnginnyknpkltrmltfkfympkkatelk hlqcleeelkpleevlnlaqsknfhlrprdlisninvivlelkgsettfmceya detativeflnrwitfcqsiistltSGGPGPAGMKGLPGSEVQLVESGGGLVQP GNSLRLSCAASGFTFSKFGMSWVRQAPGKGLEWVSSISGSGRDTLYAESVKGRF TISRDNAKTTLYLQMNSLRPEDTAVYYCTIGGSLSVSSQGTLVTVSSggggsgg ggsggggsggggsggggsggggsSGGPGPAGMKGLPGSEVQLVESGGGLVQPGG SLRLSCAASGFTFSSYTLAWVRQAPGKGLEWVAAIDSSSYTYSPDTVRGRFTIS RDNAKNSLYLQMNSLRAEDTAVYYCARDSNWDALDYWGQGTTVTVSSGGGGSGG GGSGGGGSDIQMTQSPSSLSASVGDRVTITCKASQNVGTNVGWYQQKPGKAPKA LIYSASFRYSGVPSRFSGSGSGTDFTLTISSLQPEDFATYYCQQYYTYPYTFGG GTKVEIKHHHHHH |
| 50 | ACP17 (IL2 conjugate) | QVQLQESGGGLVQAGGSLRLSCAASGRIFSIDIMSWYRQAPGKQRELVARITRG GTISYDDSVKGRFTISRDNAKNTVYLQMNSLKPEDTGVYYCNALYGTDYWGKGT QVTVSSggggsggggsggggsaptssstkktqlqlehllldlqmilnginnykn pkltrmltfkfympkkatelkhlqcleeelkpleevlnlaqsknfhlrprdlis ninvivlelkgsettfmceyadetativeflnrwitfcqsiistltSGGPGPAG MKGLPGSEVQLVESGGGLVQPGNSLRLSCAASGFTFSKFGMSWVRQAPGKGLEW VSSISGSGRDTLYAESVKGRFTISRDNAKTTLYLQMNSLRPEDTAVYYCTIGGS LSVSSQGTLVTVSSggggsggggsggggsggggsggggsggggsSGGPGPAGMK GLPGSEVQLVESGGGLVQPGGSLRLSCAASGFTFSSYTLAWVRQAPGKGLEWVA AIDSSSYTYSPDTVRGRFTISRDNAKNSLYLQMNSLRAEDTAVYYCARDSNWDA LDYWGQGTTVTVSSGGGGSGGGGSGGGGSDIQMTQSPSSLSASVGDRVTITCKA SQNVGTNVGWYQQKPGKAPKALIYSASFRYSGVPSRFSGSGSGTDFTLTISSLQ PEDFATYYCQQYYTYPYTFGGGTKVEIKHHHHHH |
| 51 | ACP18 (IL2 conjugate) | QVQLQESGGGLVQAGGSLRLSCAASGRIFSIDIMSWYRQAPGKQRELVARITRG GTISYDDSVKGRFTISRDNAKNTVYLQMNSLKPEDTGVYYCNALYGTDYWGKGT QVTVSSggggsggggsggggsaptssstkktqlqlehllldlqmilnginnykn pkltrmltfkfympkkatelkhlqcleeelkpleevlnlaqsknfhlrprdlis ninvivlelkgsettfmceyadetativeflnrwitfcqsiistltSGGPGPAG MKGLPGSEVQLVESGGGLVQPGNSLRLSCAASGFTFSKFGMSWVRQAPGKGLEW VSSISGSGRDTLYAESVKGRFTISRDNAKTTLYLQMNSLRPEDTAVYYCTIGGS LSVSSQGTLVTVSSggggsggggsggggsggggsggggsggggsEVQLVESGGG LVQPGGSLRLSCAASGFTFSSYTLAWVRQAPGKGLEWVAAIDSSSYTYSPDTVR GRFTISRDNAKNSLYLQMNSLRAEDTAVYYCARDSNWDALDYWGQGTTVTVSSs |

APPENDIX B-continued

Sequences

| SEQ ID NO. | Name | Sequence |
|---|---|---|
| | | ggpgpagmkglpgsDIQMTQSPSSLSASVGDRVTITCKASQNVGTNVGWYQQKP GKAPKALIYSASFRYSGVPSRFSGSGSGTDFTLTISSLQPEDFATYYCQQYYTY PYTFGGGTKVEIKHHHHHH |
| 52 | ACP19 (IL2 conjugate) | aptssstkktqlqlehllldlqmilnginnyknpkltrmltfkfympkkatelk hlqcleeelkpleevlnlaqsknfhlrprdlisninvivlelkgsettfmceya detativeflnrwitfcqsiistltSGGPGPAGMKGLPGSggggsggggsgggg sggggsggggsggggsEVQLVESGGGLVQPGGSLRLSCAASGFTFSSYTLAWVR QAPGKGLEWVAAIDSSSYTYSPDTVRGRFTISRDNAKNSLYLQMNSLRAEDTAV YYCARDSNWDALDYWGQGTTVTVSSGGGGSGGGGSGGGGSDIQMTQSPSSLSAS VGDRVTITCKASQNVGTNVGWYQQKPGKAPKALIYSASFRYSGVPSRFSGSGSG TDFTLTISSLQPEDFATYYCQQYYTYPYTFGGGTKVEIKggggsggggsgggg EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSggggsggggsggggsgQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSHHHHHH** |
| 53 | ACP20 (IL2 conjugate) | aptssstkktqlqlehllldlqmilnginnyknpkltrmltfkfympkkatelk hlqcleeelkpleevlnlaqsknfhlrprdlisninvivlelkgsettfmceya detativeflnrwitfcqsiistltSGGPGPAGMKGLPGSEVQLVESGGGLVQP GGSLRLSCAASGFTFSSYTLAWVRQAPGKGLEWVAAIDSSSYTYSPDTVRGRFT ISRDNAKNSLYLQMNSLRAEDTAVYYCARDSNWDALDYWGQGTTVTVSSGGGGS GGGGSGGGGSDIQMTQSPSSLSASVGDRVTITCKASQNVGTNVGWYQQKPGKAP KALIYSASFRYSGVPSRFSGSGSGTDFTLTISSLQPEDFATYYCQQYYTYPYTF GGGTKVEIKHHHHHH |
| 54 | ACP21 (IL2 conjugate) | aptssstkktqlqlehllldlqmilnginnyknpkltrmltfkfympkkatelk hlqcleeelkpleevlnlaqsknfhlrprdlisninvivlelkgsettfmceya detativeflnrwitfcqsiistltSGGPGPAGMKGLPGSggggsggggsgggg sggggsggggsggggsEVQLVESGGGLVQPGGSLRLSCAASGFTFSSYTLAWVR QAPGKGLEWVAAIDSSSYTYSPDTVRGRFTISRDNAKNSLYLQMNSLRAEDTAV YYCARDSNWDALDYWGQGTTVTVSSGGGGSGGGGSGGGGSDIQMTQSPSSLSAS VGDRVTITCKASQNVGTNVGWYQQKPGKAPKALIYSASFRYSGVPSRFSGSGSG TDFTLTISSLQPEDFATYYCQQYYTYPYTFGGGTKVEIKHHHHHH |
| 55 | ACP22 (IL2 conjugate) | aptssstkktqlqlehllldlqmilnginnyknpkltrmltfkfympkkatelk hlqcleeelkpleevlnlaqsknfhlrprdlisninvivlelkgsettfmceya detativeflnrwitfcqsiistltSGGPGPAGMKGLPGSggggsggggsgggg sggggsggggsggggsEVQLVESGGGLVQPGGSLRLSCAASGFTFSSYTLAWVR QAPGKGLEWVAAIDSSSYTYSPDTVRGRFTISRDNAKNSLYLQMNSLRAEDTAV YYCARDSNWDALDYWGQGTTVTVSSGGGGSGGGGSGGGGSDIQMTQSPSSLSAS VGDRVTITCKASQNVGTNVGWYQQKPGKAPKALIYSASFRYSGVPSRFSGSGSG TDFTLTISSLQPEDFATYYCQQYYTYPYTFGGGTKVEIKSGGPGPAGMKGLPGS EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSggggsggggsggggsgQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSHHHHHH |
| 56 | ACP23 (IL2 conjugate) | QVQLQESGGGLAQAGGSLSLSCAASGFTVSNSVMAWYRQTPGKQREFVAIINSV GSTNYADSVKGRFTISRDNAKNTVYLQMNNLKPEDTAVYVCNRNFDRIYWGQGT QVTVSSSGGPGPAGMKGLPGSEVQLVESGGGLVQPGGSLRLSCAASGFTFSSYT LAWVRQAPGKGLEWVAAIDSSSYTYSPDTVRGRFTISRDNAKNSLYLQMNSLRA EDTAVYYCARDSNWDALDYWGQGTTVTVSSGGGGSGGGGSGGGGSDIQMTQSPS SLSASVGDRVTITCKASQNVGTNVGWYQQKPGKAPKALIYSASFRYSGVPSRFS GSGSGTDFTLTISSLQPEDFATYYCQQYYTYPYTFGGGTKVEIKggggsggggs ggggsggggsggggsSGGPGPAGMKGLPGSEVQLVESGGGLVQPGNSLR LSCAASGFTFSKFGMSWVRQAPGKGLEWVSSISGSGRDTLYAESVKGRFTISRD NAKTTLYLQMNSLRPEDTAVYYCTIGGSLSVSSQGTLVTVSSSGGPGPAGMKGL PGSaptssstkktqlqlehllldlqmilnginnyknpkltrmltfkfympkkat elkhlqcleeelkpleevlnlaqsknfhlrprdlisninvivlelkgsettfmc eyadetativeflnrwitfcqsiistltHHHHHH |
| 57 | ACP24 (IL2 conjugate) | EVQLVESGGGLVQPGGSLRLSCAASGFTFSSYTLAWVRQAPGKGLEWVAAIDSS SYTYSPDTVRGRFTISRDNAKNSLYLQMNSLRAEDTAVYYCARDSNWDALDYW QGTTVTVSSGGGGSGGGGSGGGGSDIQMTQSPSSLSASVGDRVTITCKASQNVG TNVGWYQQKPGKAPKALIYSASFRYSGVPSRFSGSGSGTDFTLTISSLQPEDFA TYYCQQYYTYPYTFGGGTKVEIKSGGPGPAGMKGLPGSaptssstkktqlqleh llldlqmilnginnyknpkltrmltfkfympkkatelkhlqcleeelkpleevl nlaqsknfhlrprdlisninvivlelkgsettfmceyadetativeflnrwitf cqsiistltHHHHHH |
| 58 | ACP25 (IL2 conjugate) | EVQLVESGGGLVQPGGSLRLSCAASGFTFSSYTLAWVRQAPGKGLEWVAAIDSS SYTYSPDTVRGRFTISRDNAKNSLYLQMNSLRAEDTAVYYCARDSNWDALDYWG |

APPENDIX B-continued

Sequences

| SEQ ID NO. | Name | Sequence |
|---|---|---|
| | | QGTTVTVSSGGGGSGGGGSGGGGSDIQMTQSPSSLSASVGDRVTITCKASQNVG<br>TNVGWYQQKPGKAPKALIYSASFRYSGVPSRFSGSGSGTDFTLTISSLQPEDFA<br>TYYCQQYYTYPYTFGGGTKVEIKggggsggggsggggsggggsggggsggggsS<br>GGPGPAGMKGLPGSaptssstkktqlqlehllldlqmilnginnyknpkltrml<br>tfkfympkkatelkhlqcleeelkpleevlnlaqsknfhlrprdlisninvivl<br>elkgsettfmceyadetativeflnrwitfcqsiistltHHHHHH |
| 59 | ACP26 (IL2 conjugate) | QVQLQESGGGLVQAGGSLRLSCAASGRIFSIDIMSWYRQAPGKQRELVARITRG<br>GTISYDDSVKGRFTISRDNAKNTVYLQMNSLKPEDTGVYYCNALYGTDYWGKGT<br>QVTVSSggggsggggsggggsaptssstkktqlqlehllldlqmilnginnykn<br>pkltrmltfkfympkkatelkhlqcleeelkpleevlnlaqsknfhlrprdlis<br>ninvivlelkgsettfmceyadetativeflnrwitfcqsiistltSGGPGPAG<br>MKGLPGSEVQLVESGGGLVQPGNSLRLSCAASGFTFSKFGMSWVRQAPGKGLEW<br>VSSISGSGRDTLYAESVKGRFTISRDNAKTTLYLQMNSLRPEDTAVYYCTIGGS<br>LSVSSQGTLVTVSSggggsggggsggggsggggsQVQLQQSGAELVRPGTSVKV<br>SCKASGYAFTNYLIEWVKQRPGQGLEWIGVINPGSGGTNYNEKFKGKATLTADK<br>SSSTAYMQLSSLTSDDSAVYFCARWRGDGYYAYFDVWGAGTTVTVSSggggsgg<br>ggsggggsDIVLTQSPASLAVSLGQRATISCKASQSVDYDGDSYMNWYQQKPGQ<br>PPKLLIYAASNLESGIPARFSGSGSGTDFTLNIHPVEEEDAATYYCQQSNEDPY<br>TFGGGTKLEIKHHHHHHEPEA |
| 60 | ACP27 (IL2 conjugate) | QVQLQESGGGLVQAGGSLRLSCAASGRIFSIDIMSWYRQAPGKQRELVARITRG<br>GTISYDDSVKGRFTISRDNAKNTVYLQMNSLKPEDTGVYYCNALYGTDYWGKGT<br>QVTVSSggggsggggsggggsaptssstkktqlqlehllldlqmilnginnyfm<br>ceknpkltrmltfkfympkkatelkhlqcleeelkpleevlnlaqsknfhlrpr<br>dlisninvivlelkgsettfmceyadetativeflnrwitfcqsiistltSGGP<br>GPAGMKGLPGSEVQLVESGGGLVQPGNSLRLSCAASGFTFSKFGMSWVRQAPGK<br>GLEWVSSISGSGRDTLYAESVKGRFTISRDNAKTTLYLQMNSLRPEDTAVYYCT<br>IGGSLSVSSQGTLVTVSSggggsggggsggggsggggsDIVLTQSPASLAVSLG<br>QRATISCKASQSVDYDGDSYMNWYQQKPGQPPKLLIYAASNLESGIPARFSGSG<br>SGTDFTLNIHPVEEEDAATYYCQQSNEDPYTFGGGTKLEIKggggsggggsggg<br>gsQVQLQQSGAELVRPGTSVKVSCKASGYAFTNYLIEWVKQRPGQGLEWIGVIN<br>PGSGGTNYNEKFKGKATLTADKSSSTAYMQLSSLTSDDSAVYFCARWRGDGYYA<br>YFDVWGAGTTVTVSSHHHHHHEPEA |
| 61 | ACP28 (IL2 conjugate) | aptssstkktqlqlehllldlqmilnginnyknpkltrmltfkfympkkatelk<br>hlqcleeelkpleevlnlaqsknfhlrprdlisninvivlelkgsettfmceya<br>detativeflnrwitfcqsiistltSGGPGPAGMKGLPGSggggsggggsgggg<br>sggggsggggsQVQLQQSGAELVRPGTSVKVSCKASGYAFTNYLIEWVKQRPGQ<br>GLEWIGVINPGSGGTNYNEKFKGKATLTADKSSSTAYMQLSSLTSDDSAVYFCA<br>RWRGDGYYAYFDVWGAGTTVTVSSggggsggggsggggsggggsDIVLTQSPASLAVSL<br>GQRATISCKASQSVDYDGDSYMNWYQQKPGQPPKLLIYAASNLESGIPARFSGS<br>GSGTDFTLNIHPVEEEDAATYYCQQSNEDPYTFGGGTKLEIKggggsggggsggg<br>ggsEVQLVESGGGLVQPGNSLRLSCAASGFTFSKFGMSWVRQAPGKGLEWVSSI<br>SGSGRDTLYAESVKGRFTISRDNAKTTLYLQMNSLRPEDTAVYYCTIGGSLSVS<br>SQGTLVTVSSggggsggggsggggsQVQLQESGGGLVQAGGSLRLSCAASGRIF<br>SIDIMSWYRQAPGKQRELVARITRGGTISYDDSVKGRFTISRDNAKNTVYLQMN<br>SLKPEDTGVYYCNALYGTDYWGKGTQVTVSSHHHHRHEPEA |
| 62 | ACP29 (IL2 conjugate) | aptssstkktqlqlehllldlqmilnginnyknpkltrmltfkfympkkatelk<br>hlqcleeelkpleevlnlaqsknfhlrprdlisninvivlelkgsettfmceya<br>detativeflnrwitfcqsiistltSGGPGPAGMKGLPGSggggsggggsgggg<br>sggggsggggsDIVLTQSPASLAVSLGQRATISCKASQSVDYDGDSYMNWYQQK<br>PGQPPKLLIYAASNLESGIPARFSGSGSGTDFTLNIHPVEEEDAATYYCQQSNE<br>DPYTFGGGTKLEIKggggsggggsggggsQVQLQQSGAELVRPGTSVKVSCKAS<br>GYAFTNYLIEWVKQRPGQGLEWIGVINPGSGGTNYNEKFKGKATLTADKSSSTA<br>YMQLSSLTSDDSAVYFCARWRGDGYYAYFDVWGAGTTVTVSSggggsggggsgg<br>ggsEVQLVESGGGLVQPGNSLRLSCAASGFTFSKFGMSWVRQAPGKGLEWVSSI<br>SGSGRDTLYAESVKGRFTISRDNAKTTLYLQMNSLRPEDTAVYYCTIGGSLSVS<br>SQGTLVTVSSggggsggggsggggsQVQLQESGGGLVQAGGSLRLSCAASGRIF<br>SIDIMSWYRQAPGKQRELVARITRGGTISYDDSVKGRFTISRDNAKNTVYLQMN<br>SLKPEDTGVYYCNALYGTDYWGKGTQVTVSSHHHHHHEPEA |
| 63 | IL2Ra |          10          20          30          40          50<br>MDSYLLMWGL LTFIMVPGCQ AELCDDDPPE IPHATFKAMA YKEGTMLNCE<br>         60          70          80          90         100<br>CKRGFRRIKS GSLYMLCTGN SSHSSWDNQC QCTSSATRNT TKQVTPQPEE<br>        110        120        130        140        150<br>QKERKTTEMQ SPMQPVDQAS LPGHCREPPP WENEATERIY HFVVGQMVYY<br>        160        170        180        190        200<br>QCVQGYRALH RGPAESVCKM THGKTRWTQP QLICTGEMET SQFPGEEKPQ<br>        210        220        230        240        250<br>ASPEGRPESE TSCLVTTTDF QIQTEMAATM ETSIFTTEYQ VAVAGCVFLL<br>        260        270<br>ISVLLLSGLT WQRRQRKSRR TI |

APPENDIX B-continued

Sequences

| SEQ ID NO. | Name | Sequence |
|---|---|---|
| 64 | IL2Rb | ```
        10         20         30         40         50
MAAPALSWRL PLLILLLPLA TSWASAAVNG TSQFTCFYNS RANISCVWSQ
        60         70         80         90        100
DGALQDTSCQ VHAWPDRRRW NQTCELLPVS QASWACNLIL GAPDSQKLTT
       110        120        130        140        150
VDIVTLRVLC REGVRWRVMA IQDFKPFENL RLMAPISLQV VHVETHRCNI
       160        170        180        190        200
SWEISQASHY FERHLEFEAR TLSPGHTWEE APLLTLKQKQ EWICLETLTP
       210        220        230        240        250
DTQYEFQVRV KPLQGEFTTW SPWSQPLAFR TKPAALGKDT IPWLGHLLVG
       260        270        280        290        300
LSGAFGFIIL VYLLINCRNT GPWLKKVLKC NTPDPSKFFS QLSSEHGGDV
       310        320        330        340        350
QKWLSSPFPS SSFSPGGLAP EISPLEVLER DKVTQLLLQQ DKVPEPASLS
       360        370        380        390        400
SNHSLTSCFT NQGYFFFHLP DALEIEACQV YFTYDPYSEE DPDEGVAGAP
       410        420        430        440        450
TGSSPQPLQP LSGEDDAYCT FPSRDDLLLF SPSLLGGPSP PSTAPGGSGA
       460        470        480        490        500
GEERMPPSLQ ERVPRDWDPQ PLGPPTPGVP DLVDFQPPPE LVLREAGEEV
       510        520        530        540        550
PDAGPREGVS FPWSRPPGQG EFRALNARLP LNTDAYLSLQ ELQGQDPTHL
V
``` |
| 65 | IL2Rg | ```
        10         20         30         40         50
MLKPSLPFTS LLFLQLPLLG VGLNTTILTP NGNEDTTADF FLTTMPTDSL
        60         70         80         90        100
SVSTLPLPEV QCFVFNVEYM NCTWNSSSEP QPTNLTLHYW YKNSDNDKVQ
       110        120        130        140        150
KCSHYLFSEE ITSGCQLQKK EIHLYQTFVV QLQDPREPRR QATQMLKLQN
       160        170        180        190        200
LVIPWAPENL TLHKLSESQL ELNWNNRFLN HCLEHLVQYR TDWDHSWTEQ
       210        220        230        240        250
SVDYRHKFSL PSVDGQKRYT FRVRSRFNPL CGSAQHWSEW SHPIHWGSNT
       260        270        280        290        300
SKENPFLFAL EAVVISVGSM GLIISLLCVY FWLERTMPRI PTLKNLEDLV
       310        320        330        340        350
TEYHGNFSAW SGVSKGLAES LQPDYSERLC LVSEIPPKGG ALGEGPGASP
       360
CNQHSPYWAP PCYTLKPET
``` |
| 66 | ACP04 (human p40/murine p35 IL12 conjugate) | iwelkkdvyvveldwypdapgemvvltcdtpeedgitwtldqssevlgsgktlt iqvkefgdagqytchkggevlshslllhkkedgiwstdilkdqkepknktflr ceaknysgrftcwwlttistdltfsvkssrgssdpqgvtcgaatlsaervrgdn keyeysvecqedsacpaaeeslpievmvdavhklkyenytssffirdiikpdpp knlqlkplknsrqvevsweypdtwstphsyfsltfcvqvqgkskrekkdrvftd ktsatvicrknasisvraqdryyssswsewasvpcsggggsggggsggggsrvi pvsgparclsqsrnllkaddmvktareklkhysctaedidheditrdqtstlkt clplelhknesclatretsstttrgsclppqktslmmticlgsiyedlkmyqtef qainaalqnhnhqqiildkgmlvaidelmqslnhngetlrqkppvgeadpyrvk mklcillhafstrvvtinrvmgylssaHHHHHH |
| 67 | ACP05 (human p40/murine p35 IL12 conjugate) | iwelkkdvyvveldwypdapgemvvltcdtpeedgitwtldqssevlgsgktlt iqvkefgdagqytchkggevlshslllhkkedgiwstdilkdqkepknktflr ceaknysgrftcwwlttistdltfsvkssrgssdpqgvtcgaatlsaervrgdn keyeysvecqedsacpaaeeslpievmvdavhklkyenytssffirdiikpdpp knlqlkplknsrqvevsweypdtwstphsyfsltfcvqvqgkskrekkdrvftd ktsatvicrknasisvraqdryyssswsewasvpcsggggsggggsggggsrnl pvatpdpgmfpclhhsqnllravsnmlqkarqtlefypctseeidheditkdkt stveaclpleltknesclnsretsfitngsclasrktsfmmalclssiyedlkm yqvefktmnakllmdpkrqifldqnmlavidelmqalnfnsetvpqkssleepd fyktkiklcillhafriravtidrvmsylnasHHHHHH |
| 68 | ACP06 (human p40/murine p35 IL12 conjugate) | QSVLTQPPSVSGAPGQRVTISCSGSRSNIGSNTVKWYQQLPGTAPKLLIYYNDQ RPSGVPDRFSGSKSGTSASLAITGLQAEDEADYYCQSYDRYTHPALLFGTGTKV TVLggggsggggsggggsQVQLVESGGGVVQPGRSLRLSCAASGFTFSSYGMHW VRQAPGKGLEWVAFIRYDGSNKYYADSVKGRFTISRDNSKNTLYLQMNSLRAED TAVYYCKTHGSHDNWGQGTMVTVSSggggsggggsggggsggggsggggsgggg sSGGPGPAGMKGLPGSiwelkkdvyvveldwypdapgemvvltcdtpeedgitw tldqssevlgsgktltiqvkefgdagqytchkggevlshslllhkkedgiwst dilkdqkepknktflrceaknysgrftcwwlttistdltfsvkssrgssdpqgv tcgaatlsaervrgdnkeyeysvecqedsacpaaeeslpievmvdavhklkyen ytssffirdiikpdppknlqlkplknsrqvevsweypdtwstphsyfsltfcvq vqgkskrekkdrvftdktsatvicrknasisvraqdryyssswsewasvpcsgg |

APPENDIX B-continued

Sequences

| SEQ ID NO. | Name | Sequence |
|---|---|---|
| | | ggsggggsggggsrvipvsgparclsqsrnllkttddmvktareklkhysctae didheditrdqtstlktclplelhknesclatretssttrgsclppqktslmmt iclgsiyedlkmyqtefqainaalqnhnhqqiildkmgmlvaidelmqslnhnge tlrqkppvgeadpyrvkmklcillhafstrvvtinrvmgylssaSGGPGPAGMK GLPGSEVQLVESGGGLVQPGNSLRLSCAASGFTFSKFGMSWVRQAPGKGLEWVS SISGSGRDTLYAESVKGRFTISRDNAKTTLYLQMNSLRPEDTAVYYCTIGGSLS VSSQGTLVTVSSHHHHHHEPEA |
| 69 | ACP07 (human p40/murine p35 IL12 conjugate) | QSVLTQPPSVSGAPGQRVTISCSGSRSNIGSNTVKWYQQLPGTAPKLLIYYNDQ RPSGVPDRFSGSKSGTSASLAITGLQAEDEADYYCQSYDRYTHPALLFGTGTKV TVLggggsggggsggggsQVQLVESGGGVVQPGRSLRLSCAASGFTFSSYGMHW VRQAPGKGLEWVAFIRYDGSNKYYADSVKGRFTISRDNSKNTLYLQMNSLRAED TAVYYCKTHGSHDNWGQGTMVTVSSggggsggggsggggsggggsggggsgggg sSGGPGPAGMKGLPGSiwelkkdvyvveldwypdapgemvvltcdtpeedgitw tldqssevlgsgkfitiqvkefgdagqytchkggevlshsllllhkkedgiwst dilkdqkepknktflrceaknysgrftcwwlttistdltfsvkssrgssdpqgv tcgaatlsaervrgdnkeyeysvecqedsacpaaeeslpievmvdavhklkyen ytssffirdiikpdppknlqlkplknsrqvevsweypdtwstphsyfsltfcvq vqgkskrekkdrvftdktsatvicrknasisvraqdryyssswsewasvpcsgg gggsggggsggggsrvipvsgparclsqsrnllkttddmvktareklkhysctae didheditrdqtsfiktclplelhknesclatretssttrgsclppqktslmmt iclgsiyedlkmyqtefqainaalqnhnhqqiildkgmlvaidelmqslnhnge tlrqkppvgeadpyrvkmklcillhafstrvvtinrvmgylssaSGGPGPAGMK GLPGSEVQLVESGGGLVQPGNSLRLSCAASGFTFSKFGMSWVRQAPGKGLEWVS SISGSGRDTLYAESVKGRFTISRDNAKTTLYLQMNSLRPEDTAVYYCTIGGSLS VSSQGTLVTVSSggggsggggsggggsQVQLQESGGGLAQAGGSLSLSCAASGF TVSNSVMAWYRQTPGKQREFVAIINSVGSTNYADSVKGRFTISRDNAKNTVYLQ MNNLKPEDTAVYVCNRNFDRIYWGQGTQVTVSSHHHHHHEPEA |
| 70 | ACP08 (human p40/murine p35 IL12 conjugate) | QVQLQESGGGLAQAGGSLSLSCAASGFTVSNSVMAWYRQTPGKQREFVAIINSV GSTNYADSVKGRFTISRDNAKNTVYLQMNNLKPEDTAVYVCNRNFDRIYWGQGT QVTVSSggggsggggsggggsQSVLTQPPSVSGAPGQRVTISCSGSRSNIGSNT VKWYQQLPGTAPKLLIYYNDQRPSGVPDRFSGSKSGTSASLAITGLQAEDEADY YCQSYDRYTHPALLFGTGTKVTVLggggsggggsggggsQVQLVESGGGVVQPG RSLRLSCAASGFTFSSYGMHWVRQAPGKGLEWVAFIRYDGSNKYYADSVKGRFT ISRDNSKNTLYLQMNSLRAEDTAVYYCKTHGSHDNWGQGTMVTVSSggggsggg gsggggsggggsggggsggggsSGGPGPAGMKGLPGSiwelkkdvyvveldwyp dapgemvvltcdtpeedgitwildqssevlgsgktltiqvkefgdagqytchkg gevlshsllllhkkedgiwstdilkdqkepknktflrceaknysgrftcwwltt istdltfsvkssrgssdpqgvtcgaatlsaervrgdnkeyeysvecqedsacpa aeeslpievmvdavhklkyenytssfflrdiikpdppknlqlkplknsrqvevs weypdtwstphsyfsltfcvqvqgkskrekkdrvftdktsatvicrknasisvr aqdryyssswsewasvpcsggggsggggsggggsrvipvsgparclsqsrnllk addmvktareklkhysctaedidheditrdqtstlktclplelhknesclatre tssttrgsclppqktslmmticlgsiyedlkmyqtefqainaalqnhnhqqiil dkgmlvaidelmqslnhngetlrqkppvgeadpyrvkmklcillhafstrvvti nrvmgylssaSGGPGPAGMKGLPGSEVQLVESGGGLVQPGNSLRLSCAASGFTF SKFGMSWVRQAPGKGLEWVSSISGSGRDTLYAESVKGRFTISRDNAKTTLYLQM NSLRPEDTAVYYCTIGGSLSVSSQGTLVTVSSHHHHHHEPEA |
| 71 | ACP09 (human p40/murine p35 IL12 conjugate) | EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSggggsggggsggggsQSVLTQPPSVSGAPGQRVTISCSGSRSNIGSN TVKWYQQLPGTAPKLLIYYNDQRPSGVPDRFSGSKSGTSASLAITGLQAEDEAD YYCQSYDRYTHPALLFGTGTKVTVLggggsggggsggggsQVQLVESGGGVVQP GRSLRLSCAASGFTFSSYGMHWVRQAPGKGLEWVAFIRYDGSNKYYADSVKGRF TISRDNSKNTLYLQMNSLRAEDTAVYYCKTHGSHDNWGQGTMVTVSSggggsgg gsggggsggggsggggsggggsSGGPGPAGMKGLPGSiwelkkdvyvveldwy pdapgemvvltcdtpeedgitwfldqssevlgsgktltiqvkefgdagqytchk ggevlshsllllhkkedgiwstdilkdqkepknktflrceaknysgrftcwwlt tistdltfsvkssrgssdpqgvtcgaatlsaervrgdnkeyeysvecqedsacp aaeeslpievmvdavhklkyenytssfflrdiikpdppknlqlkplknsrqvev sweypdtwstphsyfsltfcvqvqgkskrekkdrvftdktsatvicrknasisv raqdryyssswsewasvpcsggggsggggsggggsrvipvsgparclsqsrnll kaddmvktareklkhysctaedidheditrdqtstlktclplelhknesclatr etssttrgsclppqktslmmticlgsiyedlkmyqtefqainaalqnhnhqqii ldkgmlvaidelmqslnhngetlrqkppvgeadpyrvkmklcillhafstrvvt inrvmgylssaHHHHHHEPEA |
| 72 | ACP10 (human p40/murine p35 IL12 conjugate) | EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSSGGPGPAGMKGLPGSiwelkkdvyvveldwypdapgemvvltcdtpe edgitwfidqssevlgsgktltiqvkefgdagqytchkggevlshsllllhkke dgiwstdilkdqkepknktflrceaknysgrftcwwlttistdltfsvkssrgs sdpqgvtcgaatlsaervrgdnkeyeysvecqedsacpaaeeslpievmvdavh |

APPENDIX B-continued

Sequences

| SEQ ID NO. | Name | Sequence |
|---|---|---|
| | | klkyenytssffirdiikpdppknlqlkplknsrqvevsweypdtwstphsyfs<br>ltfcvqvqgkskrekkdrvftdktsatvicrknasisvraqdryyssswsewas<br>vpcsggggsggggsggggsrvipvsgparclsqsrnllkttddmvktareklkh<br>ysctaedidheditrdqtstlktclplelhknesclatretssttrgsclppqk<br>tslmmticlgsiyedlkmyqtefqainaalqnhnhqqiildkgmlvaidelmqs<br>lnhngetlrqkppvgeadpyrvkmklcillhafstrvvtinrvmgylssaSGGP<br>GPAGMKGLPGSggggsggggsggggsggggsggggsggggsQSVLTQPPSVSGA<br>PGQRVTISCSGSRSNIGSNTVKWYQQLPGTAPKLLIYYNDQRPSGVPDRFSGSK<br>SGTSASLAITGLQAEDEADYYCQSYDRYTHPALLFGTGTKVTVLggggsggggs<br>ggggsQVQLVESGGGVVQPGRSLRLSCAASGFTFSSYGMHWVRQAPGKGLEWVA<br>FIRYDGSNKYYADSVKGRFTISRDNSKNTLYLQMNSLRAEDTAVYYCKTHGSHD<br>NWGQGTMVTVSShhHHHHHEPEA |
| 73 | ACP11<br>(human p40/murine p35 IL12 conjugate) | iwelkkdvyvveldwypdapgemvvitcdtpeedgitwtldqssevlgsgkfit<br>iqvkefgdagqytchkggevlshslllhkkedgiwstdilkdqkepknktflr<br>ceaknysgrftcwwltttistdltfsvkssrgssdpqgvtcgaatlsaervrgdn<br>keyeysvecqedsacpaaeeslpievmvdavhklkyenytssffirdiikpdpp<br>knlqlkplknsrqvevsweypdtwstphsyfsltfcvqvqgkskrekkdrvftd<br>ktsatvicrknasisvraqdryyssswsewasvpcsggggsggggsggggsrvi<br>pvsgparclsqsrnllkaddmvktareklkhysctaedidheditrdqtstlkt<br>clplelhknesclatretssttrgsclppqktslmmticlgsiyedlkmyqtef<br>qainaalqnhnhqqiildkgmlvaidelmqslnhngetlrqkppvgeadpyrvk<br>mklcillhafstrvvtinrvmgylssaSGGPGPAGMKGLPGSggggsggggsgg<br>ggsggggsggggsggggsQSVLTQPPSVSGAPGQRVTISCSGSRSNIGSNTVKW<br>YQQLPGTAPKLLIYYNDQRPSGVPDRFSGSKSGTSASLAITGLQAEDEADYYCQ<br>SYDRYTHPALLFGTGTKVTVLggggsggggsggggsQVQLVESGGGVVQPGRSL<br>RLSCAASGFTFSSYGMHWVRQAPGKGLEWVAFIRYDGSNKYYADSVKGRFTISR<br>DNSKNTLYLQMNSLRAEDTAVYYCKTHGSHDNWGQGTMVTVSSggggsggggsg<br>gggsEVQLVESGGGLVQPGNSLRLSCAASGFTFSKFGMSWVRQAPGKGLEWVSS<br>ISGSGSRDTLYAESVKGRFTISRDNAKTTLYLQMNSLRPEDTAVYYCTIGGSLSV<br>SSQGTLVTVSSHHHHHHEPEA |
| 74 | IL12 p40 human<br>(Uniprot Accession No. P29460) | 10          20         30         40         50<br>MCHQQLVISW FSLVFLASPL VAIWELKKDV YVVELDWYPD APGEMVVLTC<br>60          70         80         90         100<br>DTPEEDGITW TLDQSSEVLG SGKTLTIQVK EFGDAGQYTC HKGGEVLSHS<br>110         120        130        140        150<br>LLLLHKKEDG IWSTDILKDQ KEPKNKTFLR CEAKNYSGRF TCWWLTTIST<br>160         170        180        190        200<br>DLTFSVKSSR GSSDPQGVTC GAATLSAERV RGDNKEYEYS VECQEDSACP<br>210         220        230        240        250<br>AAEESLPIEV MVDAVHKLKY ENYTSSFFIR DIIKPDPPKN LQLKPLKNSR<br>260         270        280        290        300<br>QVEVSWEYPD TWSTPHSYFS LTFCVQVQGK SKREKKDRVF TOKTSATVIC<br>310         320<br>RKNASISVRA QORYYSSSWS EWSVPCS |
| 75 | IL12 p35 mouse<br>(Uniprot Accession No. P43431) | 10          20         30         40         50<br>MCQSRYLLFL ATLALLNHLS LARVIPVSGP ARCLSQSRNL LKTTDDMVKT<br>60          70         80         90         100<br>AREKLKHYSC TAEDIDHEDI TRDQTSTLKT CLPLELHKNE SCLATRETSS<br>110         120        130        140        150<br>TTRGSCLPPQ KTSLMMTLCL GSIYEDLKMY QTEFQAINAA LQNHNHQQII<br>160         170        180        190        200<br>LDKGMLVAID ELMQSLNHNG ETLRQKPPVG EADPYRVKMK LCILLHAFST<br>210<br>RVVTINRVMG YLSSA |
| 76 | IL12Rb-2 | 10          20         30         40         50<br>MAHTFRQCSL AFMFIITWLL IKAKIDACKR GDVIVKPSHV ILLGSTVNIT<br>60          70         80         90         100<br>CSLKPROGCF HYSPRNKLIL YKFDRRINFR HGHSLNSQVT GLPLGTTLFV<br>110         120        130        140        150<br>CKLACINSDE IQICGAETFV GVAPEQPQNL SCIQKGEQGT VACTWEPGRD<br>160         170        180        190        200<br>THLYTEYTLQ LSGPKNLTWQ KQCKDIYCDY LDFGIMLTPE SPESNFTAKV<br>210         220        230        240        250<br>TAVNSLGSSS SLPSTFTFLD IVRPLPPWDI RIKFQKASVS RCTLYWRDEQ<br>260         270        280        290        300<br>LVLLNRLRYR PSNSRLWNMV NVTKAKGRMD LLDLKPFTEY EFGISSKLHL<br>310         320        330        340        350<br>YKGSWSIWSE SLRAQTPEEE PTGMLDVWYM KPHIDYSRQQ ISLFWKNLSV<br>360         370        380        390        400<br>SEARGKILHY QVTLQELTGG KAMIQNITGH ISWITVIPRT GNWAVAVSAA<br>410         420        430        440        450 |

| SEQ ID NO. | Name | Sequence |
|---|---|---|
| | | NSKGSSLPTR INDMNLCEAQ LLAPRQVSAN VSALISENIK SYICYSIRVY<br>    460          470          480          490          500<br>VQEYVVEWRE LHPGGDIQVR LNWLRSRPYN VSALISENIK SYICYEIRVY<br>    510          520          530          540          550<br>ALSGDQGGCS SILGNSKHKA PLSGPHINAI TEEKGSILIS WNSIPVQEQM<br>    560          570          580          590          600<br>GCLLHYPIYW KERDSRSQPQ LCEIPYRVSQ NSHPINSLQP RVIYVLWMIA<br>    610          620          630          640          650<br>LTAAGESSHQ NEREFCLQGK ANWMAFVAPS ICIAIIMVGI FSTHYFQQKV<br>    660          670          680          690          700<br>FVLLAALRPQ WCSPEIRDRA NSICAKKYPI AEEKIQLRLR RLLIDWPIPE<br>    710          720          730          740          750<br>DPERLVISEY LHQVIPYFPH PPCSNWPQPE KGIQGHQASE KDMMHSASSR<br>    760          770          780          790          800<br>PPPRALQAES PQLVDLYKVL ESRGSDPKPE NPACPHTYLP AGDLPIHDGY<br>    810          820          830          840          850<br>LPSNIDDLPE HZAPLADSLE ELEPQHISLS YFPSSSLHPL TESCGDKLTL<br>    860<br>DQLKHRCDSL ML |
| 77 | IL12Rb-1 |      10           20           30           40           50<br>MEPLVIWVVP LLFLFLLSRQ GAACRTSECC FQDPPYPDAD SGSASGPRDL<br>     60           70           80           90          100<br>PCYRISSDRY ECSWQYEGPT AGVSHFLRCC LSSGRCCYFA AGSAIRLQFS<br>    110          120          130          140          150<br>DQAGVSVLYT VTLWVESWAR NQTEKSPEVT LQLYNSVKYE PPLGDIKVSK<br>    160          170          180          190          200<br>LAGQLRMEWE TPDNQVGAEV QFRHRTPSSP WKLGDCGPQB DDTESCLCPL<br>    210          220          230          240          250<br>EMNVAQEFQL RRRQLGSQGS SWSKWSSPVC VPPENPPQPQ VRFSVEQLGQ<br>    260          270          280          290          300<br>DGRPRLTKLE QPTQLELPEG CQGLAPGTEV TYRLQLHMLS CPCKAKATRT<br>    310          320          330          340          350<br>LHLGRMDYLS GAAYNVAVIS SNQFQPGLNQ TWHIPADTHT EPVALNISVG<br>    360          370          380          390          400<br>TNQTTMYWPA RAQSMTYCIE WQPVGQDGGL ATCSLTAPQD PDPAGMATYS<br>    410          420          430          440          450<br>WSRESGAMGQ EKCYYITIFA SAHPEKLTLW STVLSTYHFG GNASAAGTPH<br>    460          470          480          490          500<br>HVSVKNMSLD SVSVDWAPSL LSTCPGVLKE YVVRCRDEDS KQVSEHPVQP<br>    510          520          530          540          550<br>TETQVTLSGL RAGVAYTVQV RADTAWLRGV WSQPQRFGIE VQVSDWLTFF<br>    560          570          580          590          600<br>ASLGSFLSIL LVGVLGYLGL NRAAPHLCPP LPTPCASSAI EFPGGKEIWQ<br>    610          620          630          640          650<br>WINPVDFQEE ASLQEALVVE MSWDKGERTE PLEKIELPEG APELALDTEL<br>    660<br>SLEDGDRCKA FM |
| 79 | IL-12 p35 human (Uniprot accession P29459) |      10           20           30           40           50<br>MCHQQLVISW FSLVFLASPL VAIWELKKDV YVVELDWYPD APGEMVVLTC<br>     60           70           80           90          100<br>DTPEEDGITW TLDQSSEVLG SGKTLTIQVK EFGDAGQYTC HKGGEVLSHS<br>    110          120          130          140          150<br>LLLLHKKEDG IWSTDILKDQ KEPKNKTFLR CEAKNYSGRF TCWWLTTIST<br>    160          170          180          190          200<br>DLTFSVKSSR GSSDPQGVTC GAATLSAERV RGDNKEYEYS VECQEDSACP<br>    210          220          230          240          250<br>AAEESLPIEV MVDAVHKLKY ENYTSSFFIR DIIKPDPPKN LQLKPLKNSR<br>    260          270          280          290          300<br>QVEVSWEYPD TWSTPHSYFS LTFCVQVQGK SKREKKDRVF TDKTSATVIC<br>    310          320<br>RKNASISVRA QDRYYSSSWS EWASVPCS |
| 80 | IL-12 p40 mouse (Uniprot accession no. P43432) |      10           20           30           40           50<br>MCPQKLTISW FAIVLLVSPL MAMWELEKDV YVVEVDWTPD APGETVNLTC<br>     60           70           80           90          100<br>DTPEEDDITW TSDQRHGVIG SGKTLTITVK EFLDAGQYTC HKGGETLSHS<br>    110          120          130          140          150<br>HLLLHKKENG IWSTEILKNF KNKTFLKCEA PNYSGRFTCS WLVQRNMDLK<br>    160          170          180          190          200<br>FNIKSSSSSP DSRAVTCGMA SLSAEKVTLD QRDYEKYSVS CQEDVTCPTA<br>    210          220          230          240          250<br>EETLPIELAL EARQQNKYEN YSTSFFIRDI IKPDPPKNLQ MKPLKNSQVE<br>    260          270          280          290          300 |

APPENDIX B-continued

Sequences

| SEQ ID NO. | Name | Sequence |
|---|---|---|
| | | VSWEYPDSWS TPHSYFSLKF FVRIQRKKEK MKETEEGCNQ KGAFLVEKTS<br>        310                 320                 330<br>TEVQCKGGNV CVQAQDRYYN SSCSKWACVP CRVRS |
| 81 | ACP01<br>(mouse IFNγ conjugate) | EVQLVESGGGLVQPGNSLRLSCAASGFTFSKFGMSWVRQAPGKGLEWVSSISGS<br>GRDTLYAESVKGRFTISRDNAKTTLYLQMNSLRPEDTAVYYCTIGGSLSVSSQG<br>TLVTVSSSGGPGPAGMKGLPGShgtvieslesInnyfnssgidveekslfldiw<br>rnwqkdgdmkilqsqiisfylrlfevlkdnqaisnnisvieshlittffsnska<br>kkdafmsiakfevnnpqvqrqafnelirvvhqllpesslrkrkrsrcSGGPGPA<br>GMKGLPGSEVQLVESGGGLVQPGNSLRLSCAASGFTFSKFGMSWVRQAPGKGLE<br>WVSSISGSGRDTLYAESVKGRFTISRDNAKTTLYLQMNSLRPEDTAVYYCTIGG<br>SLSVSSQGTLVTVSSHHHHHH |
| 82 | ACP02<br>(mouse IFNγ conjugate) | EVQLVESGGGLVQPGNSLRLSCAASGFTFSKFGMSWVRQAPGKGLEWVSSISGS<br>GRDTLYAESVKGRFTISRDNAKTTLYLQMNSLRPEDTAVYYCTIGGSLSVSSQG<br>TLVTVSSSGGPGPAGMKGLPGShgtvieslesInnyfnssgidveekslfldiw<br>rnwqkdgdmkilqsqiisfylrlfevlkdnqaisnnisvieshlittffsnska<br>kkdafmsiakfevnnpqvqrqafnelirvvhqllpesslrkrkrsrcSGGPGPA<br>GMKGLPGShgtvieslesInnyfnssgidveekslfldiwrnwqkdgdmkilqs<br>qiisfylrlfevlkdnqaisnnisvieshlittffsnskakkdafmsiakfevn<br>npqvqrqafnelirvvhqllpesslrkrkrsrcSGGPGPAGMKGLPGSEVQLVE<br>SGGGLVQPGNSLRLSCAASGFTFSKFGMSWVRQAPGKGLEWVSSISGSGRDTLY<br>AESVKGRFTISRDNAKTTLYLQMNSLRPEDTAVYYCTIGGSLSVSSQGTLVTVS<br>SHHHHHH |
| 83 | ACP03<br>(mouse IFNγ conjugate) | EVQLVESGGGLVQPGNSLRLSCAASGFTFSKFGMSWVRQAPGKGLEWVSSISGS<br>GRDTLYAESVKGRFTISRDNAKTTLYLQMNSLRPEDTAVYYCTIGGSLSVSSQG<br>TLVTVSSSGGPGPAGMKGLPGShgtvieslesInnyfnssgidveekslfldiw<br>rnwqkdgdmkilqsqiisfylrlfevlkdnqaisnnisvieshlittffsnska<br>kkdafmsiakfevnnpqvqrqafnelirvvhqllpesslrkrkrsrcggggsgg<br>ggsggggshgtvieslesInnyfnssgidveekslfldiwrnwqkdgdmkilqs<br>qiisfylrlfevlkdnqaisnnisvieshlittffsnskakkdafmsiakfevn<br>npqvqrqafnelirvvhqllpesslrkrkrsrcSGGPGPAGMKGLPGSEVQLVE<br>SGGGLVQPGNSLRLSCAASGFTFSKFGMSWVRQAPGKGLEWVSSISGSGRDTLY<br>AESVKGRFTISRDNAKTTLYLQMNSLRPEDTAVYYCTIGGSLSVSSQGTLVTVS<br>SHHHHHH |
| 84 | Human IFN-g (Uniprot Accession No. P01579) |          10           20           30           40           50<br>MKYTSYILAF QLCIVLGSLG CYCQDPYVKE AENLKKYFNA GHSDVADNGT<br>         60           70           80           90          100<br>LFLGILKNWK EESDRKIMQS QIVSFYFKLF KNFKDDQSIQ KSVETIKEDM<br>        110         120         130         140         150<br>NVKFFNSNKK KRDDFEKLTN YSVTDLNVQR KAIHELIQVM AELSPAAKTG<br>        160<br>KRKRSQMLFR GRRASQ |
| 85 | Mouse IFN-g (Uniprot Accession No. P01580) |          10           20           30           40           50<br>MNATHCILAL QLFLMAVSGC YCHGTVIESL ESLNNYFNSS GIDVEEKSLF<br>         60           70           80           90          100<br>LDIWRNWQKD GDMKILQSQI ISFYLRLFEV LKDNQAISNN ISVIESHLIT<br>        110         120         130         140         150<br>TFFSNSKAKK DAFMSIAKFE VNNPQVQRQA FNELIRVVHQ LLPESSLRKR<br>KRSRC |
| 86 | ACP30<br>(mouse IFNγ conjugate) | mdmrvpaqllglllllwlrgarcEVQLVESGGGLVQPGNSLRLSCAASGFTFSKF<br>GMSWVRQAPGKGLEWVSSISGSGRDTLYAESVKGRFTISRDNAKTTLYLQMNSL<br>RPEDTAVYYCTIGGSLSVSSQGTLVTVSSSGGPGPAGMKGLPGShgtviesles<br>lnnyfnssgidveekslfldiwrnwqkdgdmkilqsqiisfylrlfevlkdnqa<br>isnnisvieshlittffsnskakkdafinsiakfevnnpqvqrqafnelirvvh<br>qllpesslrkrkrsrcSGGPGPAGMKGLPGSEVQLVESGGGLVQPGNSLRLSCA<br>ASGFTFSKFGMSWVRQAPGKGLEWVSSISGSGRDTLYAESVKGRFTISRDNAKT<br>TLYLQMNSLRPEDTAVYYCTIGGSLSVSSQGTLVTVSSSGGPGPAGMKGLPGSh<br>gtvieslesInnyfnssgidveekslfldiwrnwqkdgdmkilqsqiisfylrl<br>fevlkdnqaisnnisvieshlittffsnskakkdafinsiakfevnnpqvqrqa<br>fnelirvvhqllpesslrkrkrsrcSGGPGPAGMKGLPGSEVQLVESGGGLVQP<br>GNSLRLSCAASGFTFSKFGMSWVRQAPGKGLEWVSSISGSGRDTLYAESVKGRF<br>TISRDNAKTTLYLQMNSLRPEDTAVYYCTIGGSLSVSSQGTLVTVSSHHHHHH |
| 87 | ACP31<br>(mouse IFNα1 conjugate) | EVQLVESGGGLVQPGNSLRLSCAASGFTFSKFGMSWVRQAPGKGLEWVSSISGS<br>GRDTLYAESVKGRFTISRDNAKTTLYLQMNSLRPEDTAVYYCTIGGSLSVSSQG<br>TLVTVSSSGGPGPAGMKGLPGScdlpqthnlmkraltllvqmrrlsplsclkdr<br>kdfgfpqekvdaqqikkapipvlseltqqilniftskdssaawnttlldsfcnd<br>lhqqlndlqgclmqqvgvqefpltqedallavrkyfhrityylrekkhspcawe<br>vvraevwralsssamTlgrlreekSGGPGPAGMKGLPGSEVQLVESGGGLVQPG<br>NSLRLSCAASGFTFSKFGMSWVRQAPGKGLEWVSSISGSGRDTLYAESVKGRFT |

APPENDIX B-continued

Sequences

| SEQ ID NO. | Name | Sequence |
|---|---|---|
| | | ISRDNAKTTLYLQMNSLRPEDTAVYYCTIGGSLSVSSQGTLVTVSSHHHHHHEPEA |
| 88 | ACP32 (mouse IFNα1 conjugate) | EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGScdlpqthnlmkraltllvqmrrlsplsclkdrkdfgfpqekvdaqqikkapipvlseltqqilniftskdssaawntttlldsfcndlhqqlndlqgclmqqvgvqefpltqedallavrkyfhrityylrekkhspcawevvraevwralsssanvSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA |
| 89 | IFNγR1 | MALLFLLPLV NQGVSRAEMG TADLGPSSVP TPTNVTIESY NMNPIVYWEY QIMPQVPVFT VEVKNYGVFN SEWIDACINI SHHYCNISDH VGDPSNSLWV RVKARVGQKE SAYAKSEEFA VCRDGKIGPP KLDIRKEEKQ IMIDIFHPSV FVNGDEQEVD YDPETFCYIR VYWVYVRMNG SEIQYKILTQ KEDDCDEIQC QLAIPVSSLN SQYCVSAEGV LHVWGVTTEK SKEVCITIFN SSIKGSLWIP VVAALLLFLV LSLVFICFYI KKINFLKEKS IILPKSLISV VRSATLETKP ESKYVSLITS YQPFSLEKEV VCEEPLSPAT VPGMHTEDNP GKVEHTEELS SITEVVTIEE NIPDVVPGSH LTPIERESSS PLSSNQSEPG SIALNSYHSR NCSESDHSRN GFDTDSSCLE SHSSLSDSEF PPNWXQEIKT KGQELITVIK APTSFGYDKP HVLVDLLVDD SGKESLIGYR PTEDSKEFS |
| 90 | IFNγR2 | MRPTLLWSLL LLLGVFAAAA AAPPDPLSQL PAPQHPKIRL YMAEQVLSWE PVALSNSTRP VVYQVQEXYT DSKWFTADIM SIGVNCTQIT ATECDFTAAS PSAGFPMDFN VTLRLRASLG ALWSAWVTMP WFQHYRNVTV GPPENIEVTP GEGSLIIRFS SPFDIADTST AFFCYYVHTW EKGGIQQVKG PFRSNSISLD NLKPSRVYCL QVQAQLLWNK SNIFRVGHLS NISCYETMAD ASTELQQVIL ISVGTESLIS VLAGACFELV LKYRGLIKYW FHTPPSIPLQ IEEYLKDPTQ PILEALDKDS SPKDDVWDSV SIISFPEKEQ EDVLQIL |
| 91 | ACP51 Mouse IFG conjugate | QVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSggggsggggsggggsEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGShgtvieslesLnnyfnssgidveekslfldiwrnwqkdgdmkilqsqiisfylrlfevlkdnqaisnnisvieshlittffsnskakkdafmsiakfevnnpqvqrqafnelirvvhqllpesslrkrkrsrcSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH |
| 92 | ACP52 Mouse IFG conjugate | EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGShgtvieslesLnnyfnssgidveekslfldiwrnwqkdgdmkilqsqiisfylrlfevlkdnqaisnnisvieshlittffsnskakkdafmsiakfevnnpqvqrqafnelirvvhqllpesslrkrkrsrcSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSggggsggggsggggsQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHH |
| 93 | ACP53 Mouse IFG | eahkseiahryndlgeqhfkglvliafsqylqkcsydehaklvqevtdfaktcvadesaancdkslhtlfgdklcaipnlrenygeladccktkqepernecflqhkdd |

APPENDIX B-continued

Sequences

| SEQ ID NO. | Name | Sequence |
|---|---|---|
|  | conjugate | npslppferpeaeamctsfkenpttfmghylhevarrhpyfyapellyyaeqyn eiltqccaeadkescltpkidgykekalvssyrqrmkcssmqkfgerafkawav arisqtfpnadfaeitklatditkvnkecchgdllecaddraelakymcenqat issklqtccdkpllkkahclsevehdtmpadlpaiaadfvedqeycknyaeakd vflgtflyeysahpdysysllirlakkyeatlekccaeanppacygtvlaefqp lyeepknlyktncdlyeklgeygfqnailyrytqkapqvstptiveaarnlgrv gtkccctlpedmipcvedylsailnryllhektpysehytkccsgslverrpcf saltvdetyypkefkaetfthsdictipekekqikkqtalaelvkhkpkatae qlktvmddfaqfldtcckaadkdtcfstegpnlvtrckdalaSGGPGPAGMKGL PGShgtvieslesinnyfnssgidveeksifidiwrnwqkdgdmkilqsqiisf ylrifeylkdnqaisnnisvieshlittffsnskakkdafinsiakfeynnpqv qrqafnelirvvhqllpesslrkrkrsrcSGGPGPAGMKGLPGSeahkseiahr yndlgeqhfkglvliafsqylqkcsydehaklyqevtdfaktcvadesaancdk slhtlfgdklcaipnlrenygeladcctkqepernecflqhkddnpslppferp eaeamctsfkenpttfinghylhevarrhpyfyapellyyaeqyneiltqccae adkescitpkidgykekalvssyrqrmkcssmqkfgerafkawavarisqtfpn adfaeitklatdltkynkecchgdllecaddraelakymcenqatissklqtcc dkpllkkahclsevehdtmpadlpaiaadfvedqeycknyaeakdvflgtflye ysrrhpdysysllirlakkyeatlekccaeanppacygtvlaefqplyeepknl yktncdlyeklgeygfqnailyrytqkapqvstptlyeaarnlgrvgtkccape dmipcvedylsailnryllhektpysehytkccsgslverrpcfsaltvdety ypkefkaetfthsdictlpekekqikkqtalaelvkhkpkataeqlktvmddf aqfldtcckaadkdtcfstegpnlvtrckdalaHHHHHH |
| 94 | ACP54 Mouse IFG conjugate | eahkseiahryndlgeqhfkglyliafsqylqkcsydehaklyqevtdfaktcv adesaancdkslhtlfgdklcaipnlrenygeladcctkqepernecflqhkdd npslppferpeaeamctsfkenpttfinghylhevarrhpyfyapellyyaeqy neiltqccaeadkescltpkidgykekalvssyrqrmkcssmqkfgerafkawa varisqtfpnadfaeitklatditkvnkecchgdllecaddraelakymcenqa tissklqtccdkpllkkahclsevehdtmpadlpaiaadfvedqeycknyaeak dvflgtflyeysahpdysysllirlakkyeatlekccaeanppacygtvlaefq plyeepknlyktncdlyeklgeygfqnailyrytqkapqvstptiveaarnlgr vgtkccctlpedmipcvedylsailnryllhektpysehytkccsgslverrpc fsaltvdetyypkefkaetfthsdictipekekqikkqtalaelvkhkpkata eqlktvmddfaqfldtcckaadkdtcfstegpnlvtrckdalaSGGPGPAGMKG LPGShgtvieslesinnyfnssgidveeksifidiwrnwqkdgdmkilqsqiis fylrifeylkdnqaisnnisvieshlittffsnskakkdafinsiakfeynnpq vqrqafnelirvvhqllpesslrkrkrsrcggggsggggsggggshgtviesle slnnyfnssgidveekslfldiwmwqkdgdmkilqsqiisfylrifevlkdnqa isnnisvieshlittffsnskakkdafinsiakfeynnpqvqrqafnelirvvh qllpesslrkrkrsrcSGGPGPAGMKGLPGSeahkseiahryndlgeqhfkgly liafsqylqkcsydehaklyqevtdfaktcvadesaancdkslhtlfgdklcai pnlrenygeladcctkqepernecflqhkddnpslppferpeaeamctsfkenp ttfinghylhevarrhpyfyapellyyaeqyneiltqccaeadkescltpkidg ykekalyssvrqrmkcssmqkfgerafkawavarlsqtfpnadfaeitklatdl tkvnkecchgdllecaddraelakymcenqatissklqtccdkpllkkahclse vehdtmpadlpaiaadfvedqevcknyaeakdvflgtflyeysrrhpdysysll lrlakkyeatlekccaeanppacygtvlaefqplveepknlvktncdlyeklge ygfqnailvrytqkapqvstptiveaarnlgrvgtkcctlpedqrlpcvedyls ailnryllhektpvsehytkccsgslverrpcfsaltvdetyvpkefkaetfft fhsdictlpekekqikkqtalaelvkhkpkataeqlktvmddfaqfldtcckaa dkdtcfstegpnlvtrckdalaHHHHHH |
| 95 | ACP50 Mouse IFG conjugate | mdmrvpaqllglllwlrgarcQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSggggsggggsggggsEVQLVESGGGL VQPGNSLRLSCAASGFTFSKFGMSWVRQAPGKGLEWVSSISGSGRDTLYAESVK GRFTISRDNAKTTLYLQMNSLRPEDTAVYYCTIGGSLSVSSQGTLVTVSSSGGP GPAGMKGLPGShgtvieseslnnyfnssgidveekslfldiwmwqkdgdmkil qsqiisfylrlfevlkdnqaisnnisvieshlittffsnskakkdafmsiakfe vnnpqvqrqafnelirvvhqllpesslrkrkrsrcggggsggggsggggshgtv iesleslnnyfnssgidveekslfldiwrnwqkdgdmkilqsqiisfylrlfev lkdnqaisnnisvieshlittffsnskakkdafmsiakfevnnpqvqrqafnel irvvhqllpesslrkrkrsrcSGGPGPAGMKGLPGSEVQLVESGGGLVQPGNSL RLSCAASGFTFSKFGMSWVRQAPGKGLEWVSSISGSGRDTLYAESVKGRFTISR DNAKTTLYLQMNSLRPEDTAVYYCTIGGSLSVSSQGTLVTVSSHHHHHH |
| 96 | ACP55 Mouse IFG conjugate | mdmrvpaqllglllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGShgtviesles lnnyfnssgidveekslfldiwrnwqkdgdmkilqsqiisfylrlfevlkdnqa isnnisvieshlittffsnskakkdafmsiakfevnnpqvqrqafnelirvvhq llpesslrkrkrsrcSGGPGPAGMKGLPGSEVQLVESGGGLVQPGNSLRLSCAA SGFTFSKFGMSWVRQAPGKGLEWVSSISGSGRDTLYAESVKGRFTISRDNAKTT LYLQMNSLRPEDTAVYYCTIGGSLSVSSQGTLVTVSSSGGPGPAGMKGLPGShg |

APPENDIX B-continued

Sequences

| SEQ ID NO. | Name | Sequence |
|---|---|---|
| | | tviesleslnnyfnssgidveekslfldiwrnwqkdgdmkilqsqiisfylrlf evlkdnqaisnnisvieshlittffsnskakkdafmsiakfevnnpqvqrqafn elirvvhqllpesslrkrkrsrcSGGPGPAGMKGLPGSEVQLVESGGGLVQPGN SLRLSCAASGFTFSKFGMSWVRQAPGKGLEWVSSISGSGRDTLYAESVKGRFTI SRDNAKTTLYLQMNSLRPEDTAVYYCTIGGSLSVSSQGTLVTVSSHHHHHH |
| 97 | ACP56 Mouse IFG conjugate | mdmrvpaqllglllllwlrgarcQVQLQESGGGLAQAGGSLSLSCAASGFTVSNS VMAWYRQTPGKQREFVAIINSVGSTNYADSVKGRFTISRDNAKNTVYLQMNNLK PEDTAVYVCNRNFDRIYWGQGTQVTVSSggggsggggsggggsEVQLVESGGGL VQPGNSLRLSCAASGFTFSKFGMSWVRQAPGKGLEWVSSISGSGRDTLYAESVK GRFTISRDNAKTTLYLQMNSLRPEDTAVYYCTIGGSLSVSSQGTLVTVSSSGGP GPAGMKGLPGShgtviesleslnnyfnssgidveekslfldiwmwqkdgdmkil qsqiisfylrlfevlkdnqaisnnisvieshlittffsnskakkdafmsiakfe vnnpqvqrqafnelirvvhqllpesslrkrkrsrcSGGPGPAGMKGLPGSEVQL VESGGGLVQPGNSLRLSCAASGFTFSKFGMSWVRQAPGKGLEWVSSISGSGRDT LYAESVKGRFTISRDNAKTTLYLQMNSLRPEDTAVYYCTIGGSLSVSSQGTLVT VSSHHHHHHEPEA |
| 98 | ACP57 Mouse IFG conjugate | mdmrvpaqllglllllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGShgtviesles lnnyfnssgidveekslfldiwrnwqkdgdmkilqsqiisfylrlfevlkdnqa isnnisvieshlittffsnskakkdainsiakfevnnpqvqrqafnelirvvhq llpesslrkrkrsrcSGGPGPAGMKGLPGSEVQLVESGGGLVQPGNSLRLSCAA SGFTFSKFGMSWVRQAPGKGLEWVSSISGSGRDTLYAESVKGRFTISRDNAKTT LYLQMNSLRPEDTAVYYCTIGGSLSVSSQGTLVTVSSggggsggggsggggsQV QLQESGGGLAQAGGSLSLSCAASGFTVSNSVMAWYRQTPGKQREFVAIINSVGS TNYADSVKGRFTISRDNAKNTVYLQMNNLKPEDTAVYVCNRNFDRIYWGQGTQV TVSSHHHHHHEPEA |
| 99 | ACP58 Mouse IFG conjugate | mdmrvpaqllglllllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGShgtviesles lnnyfnssgidveekslfldiwrnwqkdgdmkilqsqiisfylrlfevlkdnqa isnnisvieshlittffsnskakkdafinsiakfevnnpqvqrqafnelirvvh qllpesslrkrkrsrcSGGPGPAGMKGLPGShgtviesleslnnyfnssgidve ekslfldiwrnwqkdgdmkilqsqiisfylrlfevlkdnqaisnnisvieshli ttffsnskakkdafmsiakfevnnpqvqrqafnelirvvhqllpesslrkrkrs rcSGGPGPAGMKGLPGSEVQLVESGGGLVQPGNSLRLSCAASGFTFSKFGMSWV RQAPGKGLEWVSSISGSGRDTLYAESVKGRFTISRDNAKTTLYLQMNSLRPEDT AVYYCTIGGSLSVSSQGTLVTVSSggggsggggsggggsQVQLQESGGGLVQAG GSLRLSCAASGRIFSIDIMSWYRQAPGKQRELVARITRGGTISYDDSVKGRFTI SRDNAKNTVYLQMNSLKPEDTGVYYCNALYGTDYWGKGTQVTVSSHHHHHHEPE A |
| 100 | ACP59 Mouse IFG conjugate | mdmrvpaqllglllllwlrgarcQVQLQESGGGLAQAGGSLSLSCAASGFTVSNS VMAWYRQTPGKQREFVAIINSVGSTNYADSVKGRFTISRDNAKNTVYLQMNNLK PEDTAVYVCNRNFDRIYWGQGTQVTVSSggggsggggsggggsEVQLVESGGGL VQPGNSLRLSCAASGFTFSKFGMSWVRQAPGKGLEWVSSISGSGRDTLYAESVK GRFTISRDNAKTTLYLQMNSLRPEDTAVYYCTIGGSLSVSSQGTLVTVSSSGGP GPAGMKGLPGShgtviesleslnnyfnssgidveekslfldiwmwqkdgdmkil qsqiisfylrlfevlkdnqaisnnisvieshlittffsnskakkdafinsiakf evnnpqvqrqafnelirvvhqllpesslrkrkrsrcSGGPGPAGMKGLPGShgt viesleslnnyfnssgidveekslfldiwrnwqkdgdmkilqsqiisfylrlfe vlkdnqaisnnisvieshlittffsnskakkdafinsiakfevnnpqvqrqafn elirvvhqllpesslrkrkrsrcSGGPGPAGMKGLPGSEVQLVESGGGLVQPGN SLRLSCAASGFTFSKFGMSWVRQAPGKGLEWVSSISGSGRDTLYAESVKGRFTI SRDNAKTTLYLQMNSLRPEDTAVYYCTIGGSLSVSSQGTLVTVSSHHHHHHEPE A |
| 101 | ACP60 Mouse IFG conjugate | mdmrvpaqllglllllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGShgtviesles lnnyfnssgidveekslfldiwrnwqkdgdmkilqsqiisfylrlfevlkdnqa isnnisvieshlittffsnskakkdafinsiakfevnnpqvqrqafnelirvvh qllpesslrkrkrsrcSGGPGPAGMKGLPGShgtviesleslnnyfnssgidve ekslfldiwrnwqkdgdmkilqsqiisfylrlfevlkdnqaisnnisvieshli ttffsnskakkdafmsiakfevnnpqvqrqafnelirvvhqllpesslrkrkrs rcSGGPGPAGMKGLPGSEVQLVESGGGLVQPGNSLRLSCAASGFTFSKFGMSWV RQAPGKGLEWVSSISGSGRDTLYAESVKGRFTISRDNAKTTLYLQMNSLRPEDT AVYYCTIGGSLSVSSQGTLVTVSSggggsggggsggggsQVQLQESGGGLAQAG GSLSLSCAASGFTVSNSVMAWYRQTPGKQREFVAIINSVGSTNYADSVKGRFTI SRDNAKNTVYLQMNNLKPEDTAVYVCNRNFDRIYWGQGTQVTVSSHHHHHHEPE A |

APPENDIX B-continued

Sequences

| SEQ ID NO. | Name | Sequence |
|---|---|---|
| 102 | ACP61 Mouse IFG conjugate | mdmrvpaqllglllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGShgtviesles lnnyfnssgidveeekslfldiwrnwqkdgdmkilqsqiisfylrlfevlkdnqa isnnisvieshlittffsnskakkdainsiakfevnnpqvqrqafnelirvvhq llpesslrkrkrsrcSGGPGPAGMKGLPGShgtviesleslnnyfnssgidvee kslfldiwrnwqkdgdmkilqsqiisfylrlfevlkdnqaisnnisvieshlit tffsnskakkdafmsiakfevnnpqvqrqafnelirvvhqllpesslrkrkrsr cSGGPGPAGMKGLPGSEVQLVESGGGLVQPGNSLRLSCAASGFTFSKFGMSWVR QAPGKGLEWVSSISGSGRDTLYAESVKGRFTISRDNAKTTLYLQMNSLRPEDTA VYYCTIGGSLSVSSQGTLVTVSSggggsggggsggggsEVQLVESGGGLVQPGG SLRLSCAASGFTFSSYAMSWVRQAPGKGLEWVSAISGSGGSTYYADSVKGRFTI SRDNSKNTLYLQMNSLRAEDTAVYYCARGVGAFRPYRKHEWGQGTLVTVSRggg gsggggsggggsSSELTQDPAVSVALGQTVRITCQGDSLRSYYASWYQQKPGQA PVLVIYGKNNRPSGIPDRFSGSSSGNTASLTTTGAQAEDEADYYCNSSPFEHNL VVFGGGTKLTVLHHHHHHEPEA |
| 103 | ACP63 Anti-FN CGS-2 scFv | mdmrvpaqllglllwlrgarcEVQLVESGGGLVQPGGSLRLSCAASGFTFSSY AMSWVRQAPGKGLEWVSAISGSGGSTYYADSVKGRFTISRDNSKNTLYLQMNSL RAEDTAVYYCARGVGAFRPYRKHEWGQGTLVTVSRggggsggggsggggsSSEL TQDPAVSVALGQTVRITCQGDSLRSYYASWYQQKPGQAPVLVIYGKNNRPSGIP DRFSGSSSGNTASLTTTGAQAEDEADYYCNSSPFEHNLVVFGGGTKLTVLHHHH HHEPEA |
| 104 | ACP69 Mouse IFG conjugate | mdmrvpaqllglllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGShgtviesles lnnyfnssgidveeekslfldiwrnwqkdgdmkilqsqiisfylrlfevlkdnqa isnnisvieshlittffsnskakkdafinsiakfevnnpqvqrqafnelirvvh qllpesslrkrkrsrcSGGPGPAGMKGLPGSEVQLVESGGGLVQPGNSLRLSCA ASGFTFSKFGMSWVRQAPGKGLEWVSSISGSGRDTLYAESVKGRFTISRDNAKT TLYLQMNSLRPEDTAVYYCTIGGSLSVSSQGTLVTVSSSGGPGPAGMKGLPGSh gtviesleslnnyfnssgidveeekslfldiwrnwqkdgdmkilqsqiisfylrl fevlkdnqaisnnisvieshlittffsnskakkdafinsiakfevnnpqvqrqa fnelirvvhqllpesslrkrkrsrcHHHHHHEPEA |
| 105 | ACP70 Mouse IFG conjugate | mdmrvpaqllglllwlrgarchgtviesleslnnyfnssgidveeekslfldiw rnwqkdgdmkilqsqiisfylrlfevlkdnqaisnnisvieshlittffsnska kkdafmsiakfevnnpqvqrqafnelirvvhqllpesslrkrkrsrcSGGPGPA GMKGLPGSEVQLVESGGGLVQPGNSLRLSCAASGFTFSKFGMSWVRQAPGKGLE WVSSISGSGRDTLYAESVKGRFTISRDNAKTTLYLQMNSLRPEDTAVYYCTIGG SLSVSSQGTLVTVSSSGGPGPAGMKGLPGShgtviesleslnnyfnssgidvee kslfldiwrnwqkdgdmkilqsqiisfylrlfevlkdnqaisnnisvieshlit tffsnskakkdafmsiakfevnnpqvqrqafnelirvvhqllpesslrkrkrsr cSGGPGPAGMKGLPGSEVQLVESGGGLVQPGNSLRLSCAASGFTFSKFGMSWVR QAPGKGLEWVSSISGSGRDTLYAESVKGRFTISRDNAKTTLYLQMNSLRPEDTA VYYCTIGGSLSVSSQGTLVTVSSHHHHHHEPEA |
| 106 | ACP71 Mouse IFG conjugate | mdmrvpaqllglllwlrgarchgtviesleslnnyfnssgidveeekslfldiw rnwqkdgdmkilqsqiisfylrlfevlkdnqaisnnisvieshlittffsnska kkdafmsiakfevnnpqvqrqafnelirvvhqllpesslrkrkrsrcSGGPGPA GMKGLPGSEAHKSEIAHRYNDLGEQHFKGLVLIAFSQYLQKCSYDEHAKLVQEV TDFAKTCVADESAANCDKSLHTLFGDKLCAIPNLRENYGELADCCTKQEPERNE CFLQHKDDNPSLPPFERPEAEAMCTSFKENPTTFMGHYLHEVARRHPYFYAPEL LYYAEQYNEILQCCAEADKESCLTPKLDGVKEKALVSSVRQRMKCSSMQKFGER AFKAWAVARLSQTFPNADFAEITKLATDLTKVNKECCHGDLLECADDRAELAKY MCENQATISSKLQTCCDKPLLKKAHCLSEVEHDTMPADLPAIAADFVEDQEVCK NYAEAKDVFLGTFLYEYSRRHPDYSVSLLLRLAKKYEATLEKCCAEANPPACYG TVLAEFQPLVEEPKNLVKTNCDLYEKLGEYGFQNAILVRYTQKAPQVSTPTLVE AARNLGRVGTKCCTLPEDQRLPCVEDYLSAILNRVCLLHEKTPVSEHVTKCCSG SLVERRPCFSALTVDETYVPKEFKAETFTFHSDICTLPEKEKQIKKQTALAELV KHKPKATAEQLKTVMDDFAQFLDTCCKAADKDTCFSTEGPNLVTRCKDALASGG PGPAGMKGLPGShgtviesleslnnyfnssgidveeksifidiwmwqkdgdmki lqsqiisfylrlfevlkdnqaisnnisvieshlittffsnskakkdafinsiak fevnnpqvqrqafnelirvvhqllpesslrkrkrsrcSGGPGPAGMKGLPGSEA HKSEIAHRYNDLGEQHFKGLVLIAFSQYLQKCSYDEHAKLVQEVTDFAKTCVAD ESAANCDKSLHTLFGDKLCAIPNLRENYGELADCCTKQEPERNECFLQHKDDNP SLPPFERPEAEAMCTSFKENPTTFMGHYLHEVARRHPYFYAPELLYYAEQYNEI LTQCCAEADKESCLTPKLDGVKEKALVSSVRQRMKCSSMQKFGERAFKAWAVAR LSQTFPNADFAEITKLATDLTKVNKECCHGDLLECADDRAELAKYMCENQATIS SKLQTCCDKPLLKKAHCLSEVEHDTMPADLPAIAADFVEDQEVCKNYAEAKDVF LGTFLYEYSRRHPDYSVSLLLRLAKKYEATLEKCCAEANPPACYGTVLAEFQPL VEEPKNLVKTNCDLYEKLGEYGFQNAILVRYTQKAPQVSTPTLVEAARNLGRVG |

APPENDIX B-continued

Sequences

| SEQ ID NO. | Name | Sequence |
|---|---|---|
|  |  | TKCCTLPEDQRLPCVEDYLSAILNRVCLLHEKTPVSEHVTKCCSGSLVERRPCF SALTVDETYVPKEFKAETFTFHSDICTLPEKEKQIKKQTALAELVKHKPKATAE QLKTVMDDFAQFLDTCCKAADKDTCFSTEGPNLVTRCKDALAHHHHHHEPEA |
| 107 | ACP72 Mouse IFG conjugate | mdmrvpaqllglllwlrgarcEAHKSEIAHRYNDLGEQHFKGLVLIAFSQYLQ KCSYDEHAKLVQEVTDFAKTCVADESAANCDKSLHTLFGDKLCAIPNLRENYGE LADCCTKQEPERNECFLQHKDDNPSLPPFERPEAEAMCTSFKENPTTFMGHYLH EVARRHPYFYAPELLYYAEQYNEILTQCCAEADKESCLTPKLDGVKEKALVSSV RQRMKCSSMQKFGERAFKAWAVARLSQTFPNADFAEITKLATDLTKVNKECCHG DLLECADDRAELAKYMCENQATISSKLQTCCDKPLLKKAHCLSEVEHDTMPADL PAIAADFVEDQEVCKNYAEAKDVFLGTFLYEYSRRHPDYSVSLLLRLAKKYEAT LEKCCAEANPPACYGTVLAEFQPLVEEPKNLVKTNCDLYEKLGEYGFQNAILVR YTQKAPQVSTPTLVEAARNLGRVGTKCCTLPEDQRLPCVEDYLSAILNRVCLLH EKTPVSEHVTKCCSGSLVERRPCFSALTVDETYVPKEFKAETFTFHSDICTLPE KEKQIKKQTALAELVKHKPKATAEQLKTVMDDFAQFLDTCCKAADKDTCFSTEG PNLVTRCKDALASGGPGPAGMKGLPGShgtviesleslnnyfrissgidveeks ifidiwrnwqkdgdmkilqsqiisfylrlfevlkdnqaisnnisvieshlittf fsnskakkdafmsiakfevnnpqvqrqafnelirvvhqllpesslrkrkrsrcS GGPGPAGMKGLPGSEAHKSEIAHRYNDLGEQHFKGLVLIAFSQYLQKCSYDEHA KLVQEVTDFAKTCVADESAANCDKSLHTLFGDKLCAIPNLRENYGELADCCTKQ EPERNECFLQHKDDNPSLPPFERPEAEAMCTSFKENPTTFMGHYLHEVARRHPY FYAPELLYYAEQYNEILTQCCAEADKESCLTPKLDGVKEKALVSSVRQRMKCSS MQKFGERAFKAWAVARLSQTFPNADFAEITKLATDLTKVNKECCHGDLLECADD RAELAKYMCENQATISSKLQTCCDKPLLKKAHCLSEVEHDTMPADLPAIAADFV EDQEVCKNYAEAKDVFLGTFLYEYSRRHPDYSVSLLLRLAKKYEATLEKCCAEA NPPACYGTVLAEFQPLVEEPKNLVKTNCDLYEKLGEYGFQNAILVRYTQKAPQV STPTLVEAARNLGRVGTKCCTLPEDQRLPCVEDYLSAILNRVCLLHEKTPVSEH VTKCCSGSLVERRPCFSALTVDETYVPKEFKAETFTFHSDICTLPEKEKQIKKQ TALAELVKHKPKATAEQLKTVMDDFAQFLDTCCKAADKDTCFSTEGPNLVTRCK DALASGGPGPAGMKGLPGShgtviesleslnnyfrissgidveeksifidiwrn wqkdgdmkilqsqiisfylrlfevlkdnqaisnnisvieshlittffsnskakk dafmsiakfevnnpqvqrqafnelirvvhqllpesslrkrkrsrcHHHHHHEPE A |
| 108 | ACP73 Mouse IFG conjugate | mdmrvpaqllglllwlrgarcEAHKSEIAHRYNDLGEQHFKGLVLIAFSQYLQ KCSYDEHAKLVQEVTDFAKTCVADESAANCDKSLHTLFGDKLCAIPNLRENYGE LADCCTKQEPERNECFLQHKDDNPSLPPFERPEAEAMCTSFKENPTTFMGHYLH EVARRHPYFYAPELLYYAEQYNEILTQCCAEADKESCLTPKLDGVKEKALVSSV RQRMKCSSMQKFGERAFKAWAVARLSQTFPNADFAEITKLATDLTKVNKECCHG DLLECADDRAELAKYMCENQATISSKLQTCCDKPLLKKAHCLSEVEHDTMPADL PAIAADFVEDQEVCKNYAEAKDVFLGTFLYEYSRRHPDYSVSLLLRLAKKYEAT LEKCCAEANPPACYGTVLAEFQPLVEEPKNLVKTNCDLYEKLGEYGFQNAILVR YTQKAPQVSTPTLVEAARNLGRVGTKCCTLPEDQRLPCVEDYLSAILNRVCLLH EKTPVSEHVTKCCSGSLVERRPCFSALTVDETYVPKEFKAETFTFHSDICTLPE KEKQIKKQTALAELVKHKPKATAEQLKTVMDDFAQFLDTCCKAADKDTCFSTEG PNLVTRCKDALASGGPGPAGMKGLPGShgtviesleslnnyfnssgidveeksl fldiwrnwqkdgdmkilqsqiisfylrlfevlkdnqaisnnisvieshlittff snskakkdafmsiakfevnnpqvqrqafnelirvvhqllpesslrkrkrsrcSG GPGPAGMKGLPGSEAHKSEIAHRYNDLGEQHFKGLVLIAFSQYLQKCSYDEHAK LVQEVTDFAKTCVADESAANCDKSLHTLFGDKLCAIPNLRENYGELADCCTKQE PERNECFLQHKDDNPSLPPFERPEAEAMCTSFKENPTTFMGHYLHEVARRHPYF YAPELLYYAEQYNEILTQCCAEADKESCLTPKLDGVKEKALVSSVRQRMKCSSM QKFGERAFKAWAVARLSQTFPNADFAEITKLATDLTKVNKECCHGDLLECADDR AELAKYMCENQATISSKLQTCCDKPLLKKAHCLSEVEHDTMPADLPAIAADFVE DQEVCKNYAEAKDVFLGTFLYEYSRRHPDYSVSLLLRLAKKYEATLEKCCAEAN PPACYGTVLAEFQPLVEEPKNLVKTNCDLYEKLGEYGFQNAILVRYTQKAPQVS TPTLVEAARNLGRVGTKCCTLPEDQRLPCVEDYLSAILNRVCLLHEKTPVSEHV TKCCSGSLVERRPCFSALTVDETYVPKEFKAETFTFHSDICTLPEKEKQIKKQT ALAELVKHKPKATAEQLKTVMDDFAQFLDTCCKAADKDTCFSTEGPNLVTRCKD ALASGGPGPAGMKGLPGShgtviesleslnnyfnssgidveeksifidiwrnwq kdgdmkilqsqiisfylrlfevlkdnqaisnnisvieshlittffsnskakkda fmsiakfevnnpqvqrqafnelirvvhqllpesslrkrkrsrcSGGPGPAGMKG LPGSEAHKSEIAHRYNDLGEQHFKGLVLIAFSQYLQKCSYDEHAKLVQEVTDFA KTCVADESAANCDKSLHTLFGDKLCAIPNLRENYGELADCCTKQEPERNECFLQ HKDDNPSLPPFERPEAEAMCTSFKENPTTFMGHYLHEVARRHPYFYAPELLYYA EQYNEILTQCCAEADKESCLTPKLDGVKEKALVSSVRQRMKCSSMQKFGERAFK AWAVARLSQTFPNADFAEITKLATDLTKVNKECCHGDLLECADDRAELAKYMCE NQATISSKLQTCCDKPLLKKAHCLSEVEHDTMPADLPAIAADFVEDQEVCKNYA EAKDVFLGTFLYEYSRRHPDYSVSLLLRLAKKYEATLEKCCAEANPPACYGTVL AEFQPLVEEPKNLVKTNCDLYEKLGEYGFQNAILVRYTQKAPQVSTPTLVEAAR NLGRVGTKCCTLPEDQRLPCVEDYLSAILNRVCLLHEKTPVSEHVTKCCSGSLV ERRPCFSALTVDETYVPKEFKAETFTFHSDICTLPEKEKQIKKQTALAELVKHK PKATAEQLKTVMDDFAQFLDTCCKAADKDTCFSTEGPNLVTRCKDALAHHHHHH EPEA |

APPENDIX B-continued

Sequences

| SEQ ID NO. | Name | Sequence |
|---|---|---|
| 109 | ACP74 Mouse IFG conjugate | mdmrvpaqllglllllwlrgarcEAHKSEIAHRYNDLGEQHFKGLVLIAFSQYLQ KCSYDEHAKLVQEVTDFAKTCVADESAANCDKSLHTLFGDKLCAIPNLRENYGE LADCCTKQEPERNECFLQHKDDNPSLPPFERPEAEAMCTSFKENPTTFMGHYLH EVARRHPYFYAPELLYYAEQYNEILTQCCAEADKESCLTPKLDGVKEKALVSSV RQRMKCSSMQKFGERAFKAWAVARLSQTFPNADFAEITKLATDLTKVNKECCHG DLLECADDRAELAKYMCENQATISSKLQTCCDKPLLKKAHCLSEVEHDTMPADL PAIAADFVEDQEVCKNYAEAKDVFLGTFLYEYSRRHPDYSVSLLLRLAKKYEAT LEKCCAEANPPACYGTVLAEFQPLVEEPKNLVKTNCDLYEKLGEYGFQNAILVR YTQKAPQVSTPTLVEAARNLGRVGTKCCTLPEDQRLPCVEDYLSAILNRVCLLH EKTPVSEHVTKCCSGSLVERRPCFSALTVDETYVPKEFKAETFTFHSDICTLPE KEKQIKKQTALAELVKHKPKATAEQLKTVMDDFAQFLDTCCKAADKDTCFSTEG PNLVTRCKDALASGGPGPAGMKGLPGShgtviesleslnnyfnssgidveeksi fidiwrnwqkdgdmkilqsqiisfylrlfevlkdnqaisnnisvieshlittff snskakkdafmsiakfevnnpqvqrqafnelirvvhqllpesslrkrkrsrcSG GPGPAGMKGLPGSggggsEAHKSEIAHRYNDLGEQHFKGLVLIAFSQYLQKCSY DEHAKLVQEVTDFAKTCVADESAANCDKSLHTLFGDKLCAIPNLRENYGELADC CTKQEPERNECFLQHKDDNPSLPPFERPEAEAMCTSFKENPTTFMGHYLHEVAR RHPYFYAPELLYYAEQYNEILTQCCAEADKESCLTPKLDGVKEKALVSSVRQRM KCSSMQKFGERAFKAWAVARLSQTFPNADFAEITKLATDLTKVNKECCHGDLLE CADDRAELAKYMCENQATISSKLQTCCDKPLLKKAHCLSEVEHDTMPADLPAIA ADFVEDQEVCKNYAEAKDVFLGTFLYEYSRRHPDYSVSLLLRLAKKYEATLEKC CAEANPPACYGTVLAEFQPLVEEPKNLVKTNCDLYEKLGEYGFQNAILVRYTQK APQVSTPTLVEAARNLGRVGTKCCTLPEDQRLPCVEDYLSAILNRVCLLHEKTP VSEHVTKCCSGSLVERRPCFSALTVDETYVPKEFKAETFTFHSDICTLPEKEKQ IKKQTALAELVKHKPKATAEQLKTVMDDFAQFLDTCCKAADKDTCFSTEGPNLV TRCKDALAggggsSGGPGPAGMKGLPGShgtviesleslnnyfnssgidveeks lfldiwrnwqkdgdmkilqsqiisfylrlfevlkdnqaisnnisvieshlittf fsnskakkdafmsiakfevnnpqvqrqafnelirvvhqllpesslrkrkrsrcS GGPGPAGMKGLPGSEAHKSEIAHRYNDLGEQHFKGLVLIAFSQYLQKCSYDEHA KLVQEVTDFAKTCVADESAANCDKSLHTLFGDKLCAIPNLRENYGELADCCTKQ EPERNECFLQHKDDNPSLPPFERPEAEAMCTSFKENPTTFMGHYLHEVARRHPY FYAPELLYYAEQYNEILTQCCAEADKESCLTPKLDGVKEKALVSSVRQRMKCSS MQKFGERAFKAWAVARLSQTFPNADFAEITKLATDLTKVNKECCHGDLLECADD RAELAKYMCENQATISSKLQTCCDKPLLKKAHCLSEVEHDTMPADLPAIAADFV EDQEVCKNYAEAKDVFLGTFLYEYSRRHPDYSVSLLLRLAKKYEATLEKCCAEA NPPACYGTVLAEFQPLVEEPKNLVKTNCDLYEKLGEYGFQNAILVRYTQKAPQV STPTLVEAARNLGRVGTKCCTLPEDQRLPCVEDYLSAILNRVCLLHEKTPVSEH VTKCCSGSLVERRPCFSALTVDETYVPKEFKAETFTFHSDICTLPEKEKQIKKQ TALAELVKHKPKATAEQLKTVMDDFAQFLDTCCKAADKDTCFSTEGPNLVTRCK DALAHHHHHHEPEA |
| 110 | ACP75 Mouse IFG conjugate | mdmrvpaqllglllllwlrgarcEAHKSEIAHRYNDLGEQHFKGLVLIAFSQYLQ KCSYDEHAKLVQEVTDFAKTCVADESAANCDKSLHTLFGDKLCAIPNLRENYGE LADCCTKQEPERNECFLQHKDDNPSLPPFERPEAEAMCTSFKENPTTFMGHYLH EVARRHPYFYAPELLYYAEQYNEILTQCCAEADKESCLTPKLDGVKEKALVSSV RQRMKCSSMQKFGERAFKAWAVARLSQTFPNADFAEITKLATDLTKVNKECCHG DLLECADDRAELAKYMCENQATISSKLQTCCDKPLLKKAHCLSEVEHDTMPADL PAIAADFVEDQEVCKNYAEAKDVFLGTFLYEYSRRHPDYSVSLLLRLAKKYEAT LEKCCAEANPPACYGTVLAEFQPLVEEPKNLVKTNCDLYEKLGEYGFQNAILVR YTQKAPQVSTPTLVEAARNLGRVGTKCCTLPEDQRLPCVEDYLSAILNRVCLLH EKTPVSEHVTKCCSGSLVERRPCFSALTVDETYVPKEFKAETFTFHSDICTLPE KEKQIKKQTALAELVKHKPKATAEQLKTVMDDFAQFLDTCCKAADKDTCFSTEG PNLVTRCKDALASGGPGPAGMKGLPGShgtviesleslnnyfnssgidveeksl fldiwrnwqkdgdmkilqsqiisfylrlfevlkdnqaisnnisvieshlittff snskakkdafmsiakfevnnpqvqrqafnelirvvhqllpesslrkrkrsrcSG GPGPAGMKGLPGSggggsggggsEAHKSEIAHRYNDLGEQHFKGLVLIAFSQYL QKCSYDEHAKLVQEVTDFAKTCVADESAANCDKSLHTLFGDKLCAIPNLRENYG ELADCCTKQEPERNECFLQHKDDNPSLPPFERPEAEAMCTSFKENPTTFMGHYL HEVARRHPYFYAPELLYYAEQYNEILTQCCAEADKESCLTPKLDGVKEKALVSS VRQRMKCSSMQKFGERAFKAWAVARLSQTFPNADFAEITKLATDLTKVNKECCH GDLLECADDRAELAKYMCENQATISSKLQTCCDKPLLKKAHCLSEVEHDTMPAD LPAIAADFVEDQEVCKNYAEAKDVFLGTFLYEYSRRHPDYSVSLLLRLAKKYEA TLEKCCAEANPPACYGTVLAEFQPLVEEPKNLVKTNCDLYEKLGEYGFQNAILV RYTQKAPQVSTPTLVEAARNLGRVGTKCCTLPEDQRLPCVEDYLSAILNRVCLL HEKTPVSEHVTKCCSGSLVERRPCFSALTVDETYVPKEFKAETFTFHSDICTLP EKEKQIKKQTALAELVKHKPKATAEQLKTVMDDFAQFLDTCCKAADKDTCFSTE GPNLVTRCKDALAggggsggggsSGGPGPAGMKGLPGShgtviesleslnnyfn ssgidveekslfldiwrnwqkdgdmkilqsqiisfylrlfevlkdnqaisnnis vieshlittffsnskakkdafmsiakfevnnpqvqrqafnelirvvhqllpess lrkrkrsrcSGGPGPAGMKGLPGSEAHKSEIAHRYNDLGEQHFKGLVLIAFSQY LQKCSYDEHAKLVQEVTDFAKTCVADESAANCDKSLHTLFGDKLCAIPNLRENY GELADCCTKQEPERNECFLQHKDDNPSLPPFERPEAEAMCTSFKENPTTFMGHY LHEVARRHPYFYAPELLYYAEQYNEILTQCCAEADKESCLTPKLDGVKEKALVS SVRQRMKCSSMQKFGERAFKAWAVARLSQTFPNADFAEITKLATDLTKVNKECC HGDLLECADDRAELAKYMCENQATISSKLQTCCDKPLLKKAHCLSEVEHDTMPA |

APPENDIX B-continued

Sequences

| SEQ ID NO. | Name | Sequence |
|---|---|---|
| | | DLPAIAADFVEDQEVCKNYAEAKDVFLGTFLYEYSRRHPDYSVSLLLRLAKKYE<br>ATLEKCCAEANPPACYGTVLAEFQPLVEEPKNLVKTNCDLYEKLGEYGFQNAIL<br>VRYTQKAPQVSTPTLVEAARNLGRVGTKCCTLPEDQRLPCVEDYLSAILNRVCL<br>LHEKTPVSEHVTKCCSGSLVERRPCFSALTVDETYVPKEFKAETFTFHSDICTL<br>PEKEKQIKKQTALAELVKHKPKATAEQLKTVMDDFAQFLDTCCKAADKDTCFST<br>EGPNLVTRCKDALAHHHHHEPEA |
| 111 | ACP78<br>Mouse IFG<br>conjugate | mdmrvpaqllglllllwlrgarcEVQLVESGGGLVQPGNSLRLSCAASGFTFSKF<br>GMSWVRQAPGKGLEWVSSISGSGRDTLYAESVKGRFTISRDNAKTTLYLQMNSL<br>RPEDTAVYYCTIGGSLSVSSQGTLVTVSSgggggsggggsggggshgtviesles<br>lnnyfnssgidveekslfldiwrnwqkdgdmkilqsqiisfylrlfevlkdnqa<br>isnnisvieshlittffsnskakkdafinsiakfevnnpqvqrqafnelirvvh<br>qllpesslrkrkrsrcggggsggggsggggsEVQLVESGGGLVQPGNSLRLSCA<br>ASGFTFSKFGMSWVRQAPGKGLEWVSSISGSGRDTLYAESVKGRFTISRDNAKT<br>TLYLQMNSLRPEDTAVYYCTIGGSLSVSSQGTLVTVSSggggsggggsggggsh<br>gtviesleslnnyfnssgidveeksifidiwrnwqkdgdmkilqsqiisfylrl<br>fevlkdnqaisnnisvieshlittffsnskakkdafmsiakfevnnpqvqrqaf<br>nelirvvhqllpesslrkrkrsrcggggsggggsggggsEVQLVESGGGLVQPG<br>NSLRLSCAASGFTFSKFGMSWVRQAPGKGLEWVSSISGSGRDTLYAESVKGRFT<br>ISRDNAKTTLYLQMNSLRPEDTAVYYCTIGGSLSVSSQGTLVTVSSHHHHHEP<br>EA |
| 112 | ACP134<br>Mouse IFG<br>conjugate | mdmrvpaqllglllllwlrgarcEVQLVESGGGLVQPGNSLRLSCAASGFTFSKF<br>GMSWVRQAPGKGLEWVSSISGSGRDTLYAESVKGRFTISRDNAKTTLYLQMNSL<br>RPEDTAVYYCTIGGSLSVSSQGTLVTVSSSGGPGPAGMKGLPGShgtviesles<br>lnnyfnssgidveekslfldiwrnwqkdgdmkilqsqiisfylrlfevlkdnqa<br>isnnisvieshlittffsnskakkdafinsiakfeynnpqvqrqafnelftyvh<br>qllpesslrkrkrsrcSGGPGPAGMKGLPGSEVQLVESGGGLVQPGNSLRLSCA<br>ASGFTFSKFGMSWVRQAPGKGLEWVSSISGSGRDTLYAESVKGRFTISRDNAKT<br>TLYLQMNSLRPEDTAVYYCTIGGSLSVSSQGTLVTVSSSGGPGPAGMKGLPGSh<br>gtviesleslnnyfnssgidveekslfldiwrnwqkdgdmkilqsqiisfylrl<br>fevlkdnqaisnnisvieshlittffsnskakkdafinsiakfeynnpqvqrqa<br>fneliryvhqllpesslrkrkrsrcSGGPGPAGMKGLPGSEVQLVESGGGLVQP<br>GNSLRLSCAASGFTFSKFGMSWVRQAPGKGLEWVSSISGSGRDTLYAESVKGRF<br>TISRDNAKTTLYLQMNSLRPEDTAVYYCTIGGSLSVSSQGTLVTVSSggggsgg<br>ggsggggsQVQLQESGGGLAQAGGSLSLSCAASGFTVSNSVMAWYRQTPGKQRE<br>FVAIINSVGSTNYADSVKGRFTISRDNAKNTVYLQMNNLKPEDTAVYVCNRNFD<br>RIYWGQGTQVTVSSHHHHHEPEA |
| 113 | ACP135<br>Mouse IFG<br>conjugate | mdmrypaqllglllllwlrgarcQVQLQESGGGLAQAGGSLSLSCAASGFTVSNS<br>VMAWYRQTPGKQREFVAIINSVGSTNYADSVKGRFTISRDNAKNTVYLQMNNLK<br>PEDTAVYVCNRNFDRIYWGQGTQVTVSSggggsggggsggggsEVQLVESGGGL<br>VQPGNSLRLSCAASGFTFSKFGMSWVRQAPGKGLEWVSSISGSGRDTLYAESVK<br>GRFTISRDNAKTTLYLQMNSLRPEDTAVYYCTIGGSLSVSSQGTLVTVSSSGGP<br>GPAGMKGLPGShgtviesleslnnyfnssgidveekslfldiwmwqkdgdmkil<br>qsqiisfylrlfevlkdnqaisnnisvieshlittffsnskakkdafinsiakf<br>eynnpqvqrqafneliryvhqllpesslrkrkrsrcSGGPGPAGMKGLPGSEVQ<br>LVESGGGLVQPGNSLRLSCAASGFTFSKFGMSWVRQAPGKGLEWVSSISGSGRD<br>TLYAESVKGRFTISRDNAKTTLYLQMNSLRPEDTAVYYCTIGGSLSVSSQGTLV<br>TVSSSGGPGPAGMKGLPGShgtviesleslnnyfnssgidveeksifidiwrnw<br>qkdgdmkilqsqiisfylrlfevlkdnqaisnnisvieshlittffsnskakkd<br>afmsiakfeynnpqvqrqafneliryvhqllpesslrkrkrsrcSGGPGPAGMK<br>GLPGSEVQLVESGGGLVQPGNSLRLSCAASGFTFSKFGMSWVRQAPGKGLEWVS<br>SISGSGRDTLYAESVKGRFTISRDNAKTTLYLQMNSLRPEDTAVYYCTIGGSLS<br>VSSQGTLVTVSSHHHHHEPEA |
| 114 | ACP34<br>Mouse IL-12<br>conjugate | mdmrypaqllglllllwlrgarcrvipvsgparclsqsrnllkttddmvktarek<br>lkhysctaedidheditrdqtstlktclplelhknesclatretssttrgsclp<br>pqktslmmticlgsiyedlkmyqtefqainaalqnhnhqqnldkgmlvaidelm<br>qslnhngetlrqkppygeadpyrykmklcillhafstryvtinrymgylssaSG<br>GPGPAGMKGLPGSmwelekdvyvveydwtpdapgetvnitcdtpeedditwtsd<br>qrhgvigsgkfitiitykefldagqytchkggetlshshlllhkkengiwsteil<br>knfknktflkceapnysgrftcswlvqrnmdlkfniksssssspdsravtcgmas<br>lsaekvtldqrdyekysyscqedvtcptaeetlpielalearqqnkyenystsf<br>firdiikpdppknlqmkplknsqveyswypdswstphsyfslkffyriqrkke<br>kmketeegcnqkgaflyektstevqckggnycyqaqdryynsscskwacypery<br>rsHHHHHH |
| 115 | ACP35<br>Mouse IL-12<br>conjugate | mdmrypaqllglllllwlrgarcrvipvsgparclsqsrnllkttddmvktarek<br>lkhysctaedidheditrdqtstlktclplelhknesclatretssttrgsclp<br>pqktslmmticlgsiyedlkmyqtefqainaalqnhnhqqnldkgmlvaidelm<br>qslnhngetlrqkppygeadpyrykmklcillhafstryvtinrymgylssagg<br>ggsggggsggggsSGGPGPAGMKGLPGSggggsggggsggggsmwelekdvyvv<br>eydwtpdapgetvnitcdtpeedditwtsdqrhgvigsgktlfitykefldagq<br>ytchkggetlshshlllhkkengiwsteilknfknktflkceapnysgrftcsw |

APPENDIX B-continued

Sequences

| SEQ ID NO. | Name | Sequence |
|---|---|---|
| | | lyqrnmdlkfnikssssspdsravtcgmaslsaekvtldqrdyekysyscqedv tcptaeetlpielalearqqnkyenystsffirdiikpdppknlqmkplknsqv evsweypdswstphsyfslkffyriqrkkekmketeegcnqkgaflyektstev qckggnycyqaqdryynsscskwacyperyrsHHHHHH |
| 116 | ACP36 Mouse IL-12 conjugate | mdmrypaqllglllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGSmwelekdvyv veydwtpdapgetvnitcdtpeedditwtsdqrhgvigsgktltfitykefldag qytchkggetlshshllhkkengiwsteilknfknktflkceapnysgrftcs wlvqrnmdlkfniksssspdsravtcgmaslsaekvtldqrdyekysyscqed vtcptaeetlpielalearqqnkyenystsffirdiikpdppknlqmkplknsq vevsweypdswstphsyfslkffvriqrkkekmketeegcnqkgaflvektste vqckggnvcvqaqdryynsscskwacvpervrsggggsggggsggggsrvipvs gparclsqsrnllkttddmvktareklkhysctaedidheditrdqtstlktcl plelhkneseclatretssttrgsclppqktslmmticlgsiyedlkmyqtefil ainaalqnhnhqqiildkgmlvaidelmqslnhngefirqkppvgeadpyrvkm klcillhafstrvvtinrvmgylssaSGGPGPAGMKGLPGSEVQLVESGGGLVQ PGNSLRLSCAASGFTFSKFGMSWVRQAPGKGLEWVSSISGSGRDTLYAESVKGR FTISRDNAKTTLYLQMNSLRPEDTAVYYCTIGGSLSVSSQGTLVTVSSHHHHHH |
| 117 | ACP37 Mouse IL-12 conjugate | mdmrvpaqllglllwlrgarcQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSggggsggggsggggsEVQLVESGGGL VQPGNSLRLSCAASGFTFSKFGMSWVRQAPGKGLEWVSSISGSGRDTLYAESVK GRFTISRDNAKTTLYLQMNSLRPEDTAVYYCTIGGSLSVSSQGTLVTVSSSGGP GPAGMKGLPGSmwelekdvyvvevdwtpdapgetvnitcdtpeedditwtsdqr hgvigsgktltitykefldagqytchkggetlshshllhkkengiwsteilkn fknktflkceapnysgrftcswlvqrnmdlkfniksssspdsravtcgmasls aekvtldqrdyekysyscqedvtcptaeetlpielalearqqnkyenystsffi rdiikpdppknlqmkplknsqvevsweypdswstphsyfslkffvriqrkkekm keteegcnqkgaflvektstevqckggnvcvqaqdryynsscskwacvpervrs ggggsggggsggggsrvipvsgparclsqsrnllkttddmvktareklkhysct aedidheditrdqtstlktclplelhkneseclatretssttrgsclppqktslm mticlgsiyedlkmyqtefqainaalqnhnhqqiildkgmlvaidelmqslnhn getlrqkppvgeadpyrvkmklcillhafstrvvtinrvmgylssaSGGPGPAG MKGLPGSEVQLVESGGGLVQPGNSLRLSCAASGFTFSKFGMSWVRQAPGKGLEW VSSISGSGRDTLYAESVKGRFTISRDNAKTTLYLQMNSLRPEDTAVYYCTIGGS LSVSSQGTLVTVSSHHHHHH |
| 118 | ACP79 Mouse IL-12 conjugate | mdmrvpaqllglllwlrgarcQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSggggsggggsggggsEVQLVESGGGL VQPGNSLRLSCAASGFTFSKFGMSWVRQAPGKGLEWVSSISGSGRDTLYAESVK GRFTISRDNAKTTLYLQMNSLRPEDTAVYYCTIGGSLSVSSQGTLVTVSSSGGP GPAGMKGLPGSmwelekdvyvvevdwtpdapgetvnitcdtpeedditwtsdqr hgvigsgktltitykefldagqytchkggetlshshllhkkengiwsteilkn fknktflkceapnysgrftcswlvqrnmdlkfniksssspdsravtcgmasls aekvtldqrdyekysyscqedvtcptaeetlpielalearqqnkyenystsffi rdiikpdppknlqmkplknsqvevsweypdswstphsyfslkffvriqrkkekm keteegcnqkgaflvektstevqckggnvcvqaqdryynsscskwacvpervrs ggggsggggsggggsrvipvsgparclsqsrnllkttddmvktareklkhysct aedidheditrdqtstlktclplelhkneseclatretssttrgsclppqktslm mticlgsiyedlkmyqtefqainaalqnhnhqqiildkgmlvaidelmqslnhn getlrqkppvgeadpyrvkmklcillhafstrvvtinrvmgylssaSGGPGPAG MKGLPGSEVQLVESGGGLVQPGNSLRLSCAASGFTFSKFGMSWVRQAPGKGLEW VSSISGSGRDTLYAESVKGRFTISRDNAKTTLYLQMNSLRPEDTAVYYCTIGGS LSVSSQGTLVTVSSHHHHHH |
| 119 | ACP80 Mouse IL-12 conjugate | mdmrvpaqllglllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGSmwelekdvyv vevdwtpdapgetvnitcdtpeedditwtsdqrhgvigsgktltitykefldag qytchkggetlshshllhkkengiwsteilknfknktflkceapnysgrftcs wlvqrnmdlkfniksssspdsravtcgmaslsaekvtldqrdyekysyscqed vtcptaeetlpielalearqqnkyenystsffirdiikpdppknlqmkplknsq vevsweypdswstphsyfslkffvriqrkkekmketeegcnqkgaflvektste vqckggnvcvqaqdryynsscskwacvpervrsggggsggggsggggsrvipvs gparclsqsrnllkttddmvktareklkhysctaedidheditrdqtstlktcl plelhkneseclatretssttrgsclppqktslmmticlgsiyedlkmyqtefqa inaalqnhnhqqiildkgmlvaidelmqslnhngefirqkppvgeadpyrvkmk lcillhafstrvvtinrvmgylssaSGGPGPAGMKGLPGSEVQLVESGGGLVQP GNSLRLSCAASGFTFSKFGMSWVRQAPGKGLEWVSSISGSGRDTLYAESVKGRF TISRDNAKTTLYLQMNSLRPEDTAVYYCTIGGSLSVSSQGTLVTVSSggggsgg ggsggggsQVQLQESGGGLVQAGGSLRLSCAASGRIFSIDIMSWYRQAPGKQRE |

APPENDIX B-continued

Sequences

| SEQ ID NO. | Name | Sequence |
|---|---|---|
| | | LVARITRGGTISYDDSVKGRFTISRDNAKNTVYLQMNSLKPEDTGVYYCNALYG TDYWGKGTQVTVSSHHHHHH |
| 120 | ACP 91 Chimeric IL-12 conjugate | mdmrvpaqllglllllwlrgarciwelkkdvyvveldwypdapgemvvltcdtpe edgitwtldqssevlgsgktltiqvkefgdagqytchkggevlshslllhkke dgiwstdilkdqkepknktflrceaknysgrftcwwlttistdltfsvkssrgs sdpqgvtcgaatlsaervrgdnkeyeysvecqedsacpaaeeslpievmvdavh klkyenytssffirdiikpdppknlqlkplknsrqvevsweypdtwstphsyfs ltfcvqvqgkskrekkdrvftdktsatvicrknasisvraqdryyssswsewas vpcsggggsggggsggggsrvipvsgparclsqsrnllkttddmvktareklkh ysctaedidheditrdqtstlktclplelhknesclatretssttrgsclppqk tslmmticlgsiyedlkmyqtefqainaalqnhnhqqiildkgmlvaidelmqs lnhngefirqkppvgeadpyrvkmklcillhafstrvvtinrvmgylssaggggs ggggsggggsggggsggggsggggsggggsggggsggggsQSVLTQPPSVSGA PGQRVTISCSGSRSNIGSNTVKWYQQLPGTAPKLLIYYNDQRPSGVPDRFSGSK SGTSASLAITGLQAEDEADYYCQSYDRYTHPALLFGTGTKVTVLggggsggggs ggggsQVQLVESGGGVVQPGRSLRLSCAASGFTFSSYGMHWVRQAPGKGLEWVA FIRYDGSNKYYADSVKGRFTISRDNSKNTLYLQMNSLRAEDTAVYYCKTHGSHD NWGQGTMVTVSSggggsggggsgggggsEVQLVESGGGLVQPGNSLRLSCAASGF TFSKFGMSWVRQAPGKGLEWVSSISGSGRDTLYAESVKGRFTISRDNAKTTLYL QMNSLRPEDTAVYYCTIGGSLSVSSQGTLVTVSSHHHHHHEPEA |
| 121 | ACP136 Chimeric IL-12 conjugate | mdmrvpaqllglllllwlrgarciwelkkdvyvveldwypdapgemvvltcdtpe edgitwtldqssevlgsgktltiqvkefgdagqytchkggevlshslllhkke dgiwstdilkdqkepknktflrceaknysgrftcwwlttistdltfsvkssrgs sdpqgvtcgaatlsaervrgdnkeyeysvecqedsacpaaeeslpievmvdavh klkyenytssffirdiikpdppknlqlkplknsrqvevsweypdtwstphsyfs ltfcvqvqgkskrekkdrvftdktsatvicrknasisvraqdryyssswsewas vpcsggggsggggsggggsrvipvsgparclsqsrnllkttddmvktareklkh ysctaedidheditrdqtstlktclplelhknesclatretssttrgsclppqk tslmmticlgsiyedlkmyqtefqainaalqnhnhqqiildkgmlvaidelmqs lnhngefirqkppvgeadpyrvkmklcillhafstrvvtinrvmgylssaSGGP GPAGMKGLPGSggggsggggsggggsggggsggggsggggsQSVLTQPPSVSGA PGQRVTISCSGSRSNIGSNTVKWYQQLPGTAPKLLIYYNDQRPSGVPDRFSGSK SGTSASLAITGLQAEDEADYYCQSYDRYTHPALLFGTGTKVTVLggggsggggs ggggsQVQLVESGGGVVQPGRSLRLSCAASGFTFSSYGMHWVRQAPGKGLEWVA FIRYDGSNKYYADSVKGRFTISRDNSKNTLYLQMNSLRAEDTAVYYCKTHGSHD NWGQGTMVTVSSHHHHHHEPEA |
| 122 | ACP138 Chimeric IL-12 conjugate | mdmrvpaqllglllllwlrgarciwelkkdvyvveldwypdapgemvvltcdtpe edgitwtldqssevlgsgktltiqvkefgdagqytchkggevlshslllhkke dgiwstdilkdqkepknktflrceaknysgrftcwwlttistdltfsvkssrgs sdpqgvtcgaatlsaervrgdnkeyeysvecqedsacpaaeeslpievmvdavh klkyenytssffirdiikpdppknlqlkplknsrqvevsweypdtwstphsyfs ltfcvqvqgkskrekkdrvftdktsatvicrknasisvraqdryyssswsewas vpcsggggsggggsggggsrvipvsgparclsqsrnllkttddmvktareklkh ysctaedidheditrdqtstlktclplelhknesclatretssttrgsclppqk tslmmticlgsiyedlkmyqtefqainaalqnhnhqqiildkgmlvaidelmqs lnhngefirqkppvgeadpyrvkmklcillhafstrvvtinrvmgylssaSGGP GPAGMKGLPGSggggsggggsggggsggggsggggsggggsQSVLTQPPSVSGA PGQRVTISCSGSRSNIGSNTVKWYQQLPGTAPKLLIYYNDQRPSGVPDRFSGSK SGTSASLAITGLQAEDEADYYCQSYDRYTHPALLFGTGTKVTVLggggsggggs ggggsQVQLVESGGGVVQPGRSLRLSCAASGFTFSSYGMHWVRQAPGKGLEWVA FIRYDGSNKYYADSVKGRFTISRDNSKNTLYLQMNSLRAEDTAVYYCKTHGSHD NWGQGTMVTVSSggggsggggsgggggsEVQLVESGGGLVQPGNSLRLSCAASGF TFSKFGMSWVRQAPGKGLEWVSSISGSGRDTLYAESVKGRFTISRDNAKTTLYL QMNSLRPEDTAVYYCTIGGSLSVSSQGTLVTVSSggggsggggsggggsQVQLQ ESGGGLAQAGGSLSLSCAASGFTVSNSVMAWYRQTPGKQREFVAIINSVGSTNY ADSVKGRFTISRDNAKNTVYLQMNNLKPEDTAVYVCNRNFDRIYWGQGTQVTVS SHHHHHHEPEA |
| 123 | ACP139 Chimeric IL-12 conjugate | mdmrvpaqllglllllwlrgarcQVQLQESGGGLAQAGGSLSLSCAASGFTVSNS VMAWYRQTPGKQREFVAIINSVGSTNYADSVKGRFTISRDNAKNTVYLQMNNLK PEDTAVYVCNRNFDRIYWGQGTQVTVSSggggsggggsggggsiwelkkdvyv veldwypdapgemvvltcdtpeedgitwtldqssevlgsgktltiqvkefgdag qytchkggevlshslllhkkedgiwstdilkdqkepknktfIrceaknysgrf tcwwlttistdltfsvkssrgssdpqgvtcgaatlsaervrgdnkeyeysvecq edsacpaaeeslpievmvdavhklkyenytssffirdiikpdppknlqlkplkn srqvevsweypdtwstphsyfsltfcvqvqgkskrekkdrvftdktsatvicrk nasisvraqdryyssswsewasvpcsggggsggggsggggsrvipvsgparcls qsrnllkttddmvktareklkhysctaedidheditrdqtstlktclplelhkn esclatretssttrgsclppqktslmmticlgsiyedlkmyqtefqainaalqn hnhqqiildkgmlvaidelmqslnhngetlrqkppvgeadpyrvkmklcillha fstrvvtinrvmgylssaSGGPGPAGMKGLPGSggggsggggsggggsggggsg ggggsggggsQSVLTQPPSVSGAPGQRVTISCSGSRSNIGSNTVKWYQQLPGTAP |

APPENDIX B-continued

Sequences

| SEQ ID NO. | Name | Sequence |
|---|---|---|
| | | KLLIYYNDQRPSGVPDRFSGSKSGTSASLAITGLQAEDEADYYCQSYDRYTHPA LLFGTGTKVTVLggggsggggsggggsQVQLVESGGGVVQPGRSLRLSCAASGF TFSSYGMHWVRQAPGKGLEWVAFIRYDGSNKYYADSVKGRFTISRDNSKNTLYL QMNSLRAEDTAVYYCKTHGSHDNWGQGTMVTVSSggggsggggsggggsEVQLV ESGGGLVQPGNSLRLSCAASGFTFSKFGMSWVRQAPGKGLEWVSSISGSRDTL YAESVKGRFTISRDNAKTTLYLQMNSLRPEDTAVYYCTIGGSLSVSSQGTLVTV SSHHHHHHEPEA |
| 124 | ACP140 Chimeric IL-12 conjugate | mdmrvpaqllglllllwlrgarcQVQLESGGGLAQAGGSL APPENDIX B-continued Sequences

| SEQ ID NO. | Name | Sequence |
|---|---|---|
| | | qmvyyqcvqgyralhrgpaesyclunthgktrwtqpqlictgemetsqfpgeek pqaspegrpesetsclvtadfqiqtemaatmetsifteyqHHHHHH |
| 129 | ACP42 IL-2 conjugate | mdmrvpaqllglllllwlrgarcEVQLVESGGGLVQPGNSLRLSCAASGFTFSKF GMSWVRQAPGKGLEWVSSISGSGRDTLYAESVKGRFTISRDNAKTTYLQMNSLR PEDTAVYYCTIGGSLSVSSQGTLVTVSSggggsggggsggggselcdddppeip hatfkamaykegtmlnceckrgfrriksgslymlctgnsshsswdnqcqctssa trntttkqvtpqpeeqkerkttemqspmqpvdqaslpghcrepppweneateriy hfvvgqmvyyqcvqgyralhrgpaesyckmthgktrwtqpqlictgemetsqfp geekpqaspegrpesetsclvtttdfqiqtemaatmetsifteyqggggsggg gsggggsggggsggggsggggsSGGPGPAGMKGLPGSaptssstkktqlqlehl lldlqmilnginnyknpkltrmlafymppkkatelkhlqcleeelkpleeylnla qsknfhlrprdlisninyiylelkgsettfmceyadetatiyeflnrwitfcqs iistltHHHHHH |
| 130 | ACP43 IL-2 conjugate | mdmrvpaqllglllllwlrgarcaptssstkktqlqlehlldlqmilnginnyk npkltrmltfkfympkkatelkhlqcleeelkpleeylnlaqsknfhlrprdli sninyiylelkgsettfmceyadetatiyeflnrwitfcqsiistltSGGPGPA GMKGLPGSggggsggggsggggsggggsggggsggggselcdddppeiphatfk amaykegtmlnceckrgfrriksgslymlctgnsshsswdnqcqctssatrntt kqvtpqpeeqkerkttemqspmqpydqaslpghcrepppweneateriyhfvyg qmyyyqcyqgyralhrgpaesyclonthgktrwtqpqlictgemetsqfpgeek pqaspegrpesetsclytadfqiqtemaatmetsifteyqggggsggggsggg gsEVQLVESGGGLVQPGNSLRLSCAASGFTFSKFGMSWVRQAPGKGLEWVSSIS GSGRDTLYAESVKGRFTISRDNAKTTLYLQMNSLRPEDTAVYYCTIGGSLSVSS QGTLVTVSSHHHHHH |
| 131 | ACP44 IL-2 conjugate | mdmrvpaqllglllllwlrgarcaptssstkktqlqlehlldlqmilnginnyk npkltrmltfkfympkkatelkhlqcleeelkpleeylnlaqsknfhlrprdli sninyiylelkgsettfmceyadetatiyeflnrwitfcqsiistltSGGPGPA GMKGLPGSggggsggggsggggsggggsggggsggggselcdddppeiphatfk amaykegtmlnceckrgfrriksgslymlctgnsshsswdnqcqctssatrntt kqvtpqpeeqkerkttemqspmqpydqaslpghcrepppweneateriyhfvyg qmyyyqcyqgyralhrgpaesyclonthgktrwtqpqlictgemetsqfpgeek pqaspegrpesetsclytadfqiqtemaatmetsifteyqSGGPGPAGMKGLP GSEVQLVESGGGLVQPGNSLRLSCAASGFTFSKFGMSWVRQAPGKGLEWVSSIS GSGRDTLYAESVKGRFTISRDNAKTTLYLQMNSLRPEDTAVYYCTIGGSLSVSS QGTLVTVSSHHHHHH |
| 132 | ACP45 IL-2 conjugate | mdmrvpaqllglllllwlrgarcEVQLVESGGGLVQPGNSLRLSCAASGFTFSKF GMSWVRQAPGKGLEWVSSISGSGRDTLYAESVKGRFTISRDNAKTTYLQMNSL RPEDTAVYYCTIGGSLSVSSQGTLVTVSSSGGPGPAGMKGLPGSEVQLVESGGG LVQPGGSLRLSCAASGFTFSSYTLAWVRQAPGKGLEWVAAIDSSSYTYSPDTVR GRFTISRDNAKNSLYLQMNSLRAEDTAVYYCARDSNWDALDYWGQGTTVTVSSG GGGSGGGGSGGGGSDIQMTQSPSSLSASVGDRVTITCKASQNVGTNVGWYQQKP GKAPKALIYSASFRYSGVPSRFSGSGSGTDFTLTISSLQPEDFATYYCQQYYTY PYTFGGGTKVEIKggggsggggsggggsggggsggggsggggsSGGPGPAGMKG LPGSaptssstkktqlqlehlldlqmilnginnyknpkltrmltfkfympkka telkhlqcleeelkpleeylnlaqsknfhlrprdlisninyiylelkgsettfm ceyadetatiyeflnrwitfcqsiistltHHHHHH |
| 133 | ACP46 IL-2 conjugate | mdmrvpaqllglllllwlrgarcaptssstkktqlqlehlldlqmilnginnyk npkltrmltfkfympkkatelkhlqcleeelkpleeylnlaqsknfhlrprdli sninyiylelkgsettfmceyadetatiyeflnrwitfcqsiistltSGGPGPA GMKGLPGSggggsggggsggggsggggsggggsggggsEVQLVESGGGLVQPGG SLRLSCAASGFTFSSYTLAWVRQAPGKGLEWVAAIDSSSYTYSPDTVRGRFTIS RDNAKNSLYLQMNSLRAEDTAVYYCARDSNWDALDYWGQGTTVTVSSsggpgpa gmkglpgsDIQMTQSPSSLSASVGDRVTITCKASQNVGTNVGWYQQKPGKAPKA LIYSASFRYSGVPSRFSGSGSGTDFTLTISSLQPEDFATYYCQQYYTYPYTFGG GTKVEIKggggsggggsggggsEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSggggsggggsggggsQVQLQESGGG LVQAGGSLRLSCAASGRIFSIDIMSWYRQAPGKQRELVARITRGGTISYDDSVK GRFTISRDNAKNTVYLQMNSLKPEDTGVYYCNALYGTDYWGKGTQVTVSSHHHH HH |
| 134 | ACP47 IL-2 conujgate | mdmrvpaqllglllllwlrgarcQVQLQESGGGLVQAGGSLRLSCAASGRIFSID IMSWYRQAPGKQRELVARITRGGTISYDDSVKGRFTISRDNAKNTVYQMNSLKP EDTGVYYCNALYGTDYWGKGTQVTVSSggggsggggsggggsaptssstkktql qlehlldlqmilnginnyknpkltrmltfkfympkkatelkhlqcleeelkpl eeylnlaqsknfhlrprdlisninvivlelkgsettinceyadetativeflnr witfcqsiistltSGGPGPAGMKGLPGSEVQLVESGGGLVQPGNSLRLSCAASG FTFSKFGMSWVRQAPGKGLEWVSSISGSGRDTLYAESVKGRFTISRDNAKTTLY LQMNSLRPEDTAVYYCTIGGSLSVSSQGTLVTVSSggggsggggsggggsgggg sggggsggggsEVQLVESGGGLVQPGGSLRLSCAASGFTFSSYTLAWVRQAPGK |

APPENDIX B-continued

Sequences

| SEQ ID NO. | Name | Sequence |
|---|---|---|
| | | GLEWVAAIDSSSYTYSPDTVRGRFTISRDNAKNSLYLQMNSLRAEDTAVYYCAR DSNWDALDYWGQGTTVTVSSGGGGSGGGGSGGGGSDIQMTQSPSSLSASVGDRV TITCKASQNVGTNVGWYQQKPGKAPKALIYSASFRYSGVPSRFSGSGSGTDFTL TISSLQPEDFATYYCQQYYTYPYTFGGGTKVEIKHHHHHH |
| 135 | ACP48 IL-2 conjugate | mdmrvpaqllglllllwlrgarcaptssstkktqlqlehllldlqmilnginnyk npkltrmltfldympkkatelkhlqcleeelkpleevlnlaqsknfhlrprdli sninvivlvelkgsettfmceyadetativeflnrwitfcqsiistltSGGPGPA GMKGLPGSEVQLVESGGGLVQPGGSLRLSCAASGFTFSSYTLAWVRQAPGKGLE WVAAIDSSSYTYSPDTVRGRFTISRDNAKNSLYLQMNSLRAEDTAVYYCARDSN WDALDYWGQGTTVTVSSGGGGSGGGGSGGGGSDIQMTQSPSSLSASVGDRVTIT CKASQNVGTNVGWYQQKPGKAPKALIYSASFRYSGVPSRFSGSGSGTDFTLTIS SLQPEDFATYYCQQYYTYPYTFGGGTKVEIKggggsggggsggggsEVQLVESG GGLVQPGNSLRLSCAASGFTFSKFGMSWVRQAPGKGLEWVSSISGSSRDTLYAE SVKGRFTISRDNAKTTLYLQMNSLRPEDTAVYYCTIGGSLSVSSQGTLVTVSSH HHHHH |
| 136 | ACP49 IL-2 conjugate | mdmrvpaqllglllllwlrgarcaptssstkktqlqlehllldlqmilnginnyk npkltrmltfldympkkatelkhlqcleeelkpleevlnlaqsknfhlrprdli sninvivlvelkgsettfmceyadetativeflnrwitfcqsiistltSGGPGPA GMKGLPGSggggsggggsggggsggggsggggsggggsEVQLVESGGGLVQPGG SLRLSCAASGFTFSSYTLAWVRQAPGKGLEWVAAIDSSSYTYSPDTVRGRFTIS RDNAKNSLYLQMNSLRAEDTAVYYCARDSNWDALDYWGQGTTVTVSSGGGGSGG GGSGGGGSDIQMTQSPSSLSASVGDRVTITCKASQNVGTNVGWYQQKPGKAPKA LIYSASFRYSGVPSRFSGSGSGTDFTLTISSLQPEDFATYYCQQYYTYPYTFGG GTKVEIKggggsggggsggggsEVQLVESGGGLVQPGNSLRLSCAASGFTFSKF GMSWVRQAPGKGLEWVSSISGSSRDTLYAESVKGRFTISRDNAKTTLYLQMNSL RPEDTAVYYCTIGGSLSVSSQGTLVTVSSHHHHHH |
| 137 | ACP92 IL-2 conjugate | mdmrvpaqllglllllwlrgarcEVQLVESGGGLVQPGNSLRLSCAASGFTFSKF GMSWVRQAPGKGLEWVSSISGSSRDTLYAESVKGRFTISRDNAKTTLYLQMNSL RPEDTAVYYCTIGGSLSVSSQGTLVTVSSSGGPGPAGMKGLPGSaptssstkkt qlqlehllldlqmilnginnyknpkltrmltfkfympkkatelkhlqcleeelk pleevinlaqsknfhlrprdlisninvivlelkgsettfmceyadetativefl nrwitfcqsiistltSGGPGPAGMKGLPGSEVQLVESGGGLVQPGNSLRLSCAA SGFTFSKFGMSWVRQAPGKGLEWVSSISGSSRDTLYAESVKGRFTISRDNAKTT LYLQMNSLRPEDTAVYYCTIGGSLSVSSQGTLVTVSSHHHHHH |
| 138 | ACP93 IL-2 conjugate | mdmrvpaqllglllllwlrgarcQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSgsgsgsgsgsgsgsgsgsEVQLVESGGG LVQPGNSLRLSCAASGFTFSKFGMSWVRQAPGKGLEWVSSISGSSRDTLYAESV KGRFTISRDNAKTTLYLQMNSLRPEDTAVYYCTIGGSLSVSSQGTLVTVSSgsg sgsgsgsgsgsgsgsQVQLQESGGGLVQAGGSLRLSCAASGRIFSIDIMSWYRQAP GKQRELVARITRGGTISYDDSVKGRFTISRDNAKNTVYLQMNSLKPEDTGVYYC NALYGTDYWGKGTQVTVSSgsgsgsgsgsgsgsgsEVQLVESGGGLVQPGGSLR LSCAASGFTFSSYTLAWVRQAPGKGLEWVAAIDSSSYTYSPDTVRGRFTISRDN AKNSLYLQMNSLRAEDTAVYYCARDSNWDALDYWGQGTTVTVSSGGGGSGGGGS GGGGSDIQMTQSPSSLSASVGDRVTITCKASQNVGTNVGWYQQKPGKAPKALIY SASFRYSGVPSRFSGSGSGTDFTLTISSLQPEDFATYYCQQYYTYPYTFGGGTK VEIKSGGPGPAGMKGLPGSaptssstkktqlqlehllldlqmilnginnyknpk ltrmlafympkkatelkhlqcleeelkpleevlnlaqsknfhlrprdlisninv ivlelkgsettfmceyadetativeflnrwitfcqsiistltHHHHHH |
| 139 | ACP94 IL-2 conjugate | mdmrvpaqllglllllwlrgarcQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSgsgsgsgsgsgsgsgsgsEVQLVESGGG LVQPGNSLRLSCAASGFTFSKFGMSWVRQAPGKGLEWVSSISGSSRDTLYAESV KGRFTISRDNAKTTLYLQMNSLRPEDTAVYYCTIGGSLSVSSQGTLVTVSSgsg sgsgsgsgsgsgsgsEVQLVESGGGLVQPGGSLRLSCAASGFTFSSYTLAWVRQAP GKGLEWVAAIDSSSYTYSPDTVRGRFTISRDNAKNSLYLQMNSLRAEDTAVYYC ARDSNWDALDYWGQGTTVTVSSGGGGSGGGGSGGGGSDIQMTQSPSSLSASVGD RVTITCKASQNVGTNVGWYQQKPGKAPKALIYSASFRYSGVPSRFSGSGSGTDF TLTISSLQPEDFATYYCQQYYTYPYTFGGGTKVEIKSGGPGPAGMKGLPGSapt ssstkktqlqlehllldlqmilnginnyknpkltrmlafympkkatelkhlqcl eeelkpleevlnlaqsknfhlrprdlisninvivlelkgsettfmceyadetat iveflnrwitfcqsiistltHHHHHH |
| 140 | ACP95 IL-2 conjugate | mdmrvpaqllglllllwlrgarcQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSgsgsgsgsgsgsgsgsgsEVQLVESGGG LVQPGNSLRLSCAASGFTFSKFGMSWVRQAPGKGLEWVSSISGSSRDTLYAESV KGRFTISRDNAKTTLYLQMNSLRPEDTAVYYCTIGGSLSVSSQGTLVTVSSSGG PGPAGMKGLPGSaptssstkktqlqlehllldlqmilnginnyknpkltrmltf |

APPENDIX B-continued

Sequences

| SEQ ID NO. | Name | Sequence |
|---|---|---|
| | | kfympkkatelkhlqcleeelkpleevlnlaqsknfhlrprdlisnnvivlelk<br>gsettfmceyadetativeflnrwitfcqsiistltHHHHHH |
| 141 | ACP96<br>IL-2<br>conjugate | mdmrvpaqllglllllwlrgarcQVQLQESGGGLVQAGGSLRLSCAASGRIFSID<br>IMSWYRQAPGKQRELVARITRGGTISYDDSVKGRFTISRDNAKNTVYLQMNSLK<br>PEDTGVYYCNALYGTDYWGKGTQVTVSSSGGPGPAGMKGLPGSaptssstkktq<br>lqlehllldlqmilnginnyknpkltrmltfkfympkkatelkhlqcleeelkp<br>leevlnlaqsknfhlrprdlisninvivlelkgsettfmceyadetativefln<br>rwitfcqsiistltSGGPGPAGMKGLPGSEVQLVESGGGLVQPGNSLRLSCAAS<br>GFTFSKFGMSWVRQAPGKGLEWVSSISGSGRDTLYAESVKGRFTISRDNAKTTL<br>YLQMNSLRPEDTAVYYCTIGGSLSVSSQGTLVTVSSHHHHHH |
| 142 | ACP97<br>IL-2<br>conjugate | mdmrvpaqllglllllwlrgarcQVQLQESGGGLVQAGGSLRLSCAASGRIFSID<br>IMSWYRQAPGKQRELVARITRGGTISYDDSVKGRFTISRDNAKNTVYLQMNSLK<br>PEDTGVYYCNALYGTDYWGKGTQVTVSSggggsggggsggggsEVQLVESGGGL<br>VQPGNSLRLSCAASGFTFSKFGMSWVRQAPGKGLEWVSSISGSGRDTLYAESVK<br>GRFTISRDNAKTTLYLQMNSLRPEDTAVYYCTIGGSLSVSSQGTLVTVSSSGGP<br>GPAGMKGLPGSaptssstkktqlqlehllldlqmilnginnyknpkltrmltfk<br>fympkkatelkhlqcleeelkpleevlnlaqsknfhlrprdlisninvivlelk<br>gsettfmceyadetativeflnrwitfcqsiistltSGGPGPAGMKGLPGSEVQ<br>LVESGGGLVQPGNSLRLSCAASGFTFSKFGMSWVRQAPGKGLEWVSSISGSGRD<br>TLYAESVKGRFTISRDNAKTTLYLQMNSLRPEDTAVYYCTIGGSLSVSSQGTLV<br>TVSSHHHHHH |
| 143 | ACP99<br>IL-2<br>conjugate | mdmrvpaqllglllllwlrgarcQVQLQESGGGLVQAGGSLRLSCAASGRIFSID<br>IMSWYRQAPGKQRELVARITRGGTISYDDSVKGRFTISRDNAKNTVYLQMNSLK<br>PEDTGVYYCNALYGTDYWGKGTQVTVSSggggsggggsggggsaptssstkktq<br>lqlehllldlqmilnginnyknpkltrmltfkfympkkatelkhlqcleeelkp<br>leevlnlaqsknfhlrprdlisninvivlelkgsettfmceyadetativefln<br>rwitfcqsiistltSGGPGPAGMKGLPGSEVQLVESGGGLVQPGNSLRLSCAAS<br>GFTFSKFGMSWVRQAPGKGLEWVSSISGSGRDTLYAESVKGRFTISRDNAKTTL<br>YLQMNSLRPEDTAVYYCTIGGSLSVSSQGTLVTVSSHHHHHH |
| 144 | ACP100<br>IL-2<br>conjugate | mdmrvpaqllglllllwlrgarcQVQLQESGGGLVQAGGSLRLSCAASGRIFSID<br>IMSWYRQAPGKQRELVARITRGGTISYDDSVKGRFTISRDNAKNTVYLQMNSLK<br>PEDTGVYYCNALYGTDYWGKGTQVTVSSggggsggggsggggsaptssstkktq<br>lqlehllldlqmilnginnyknpkltrmltfkfympkkatelkhlqcleeelkp<br>leevlnlaqsknfhlrprdlisninvivlelkgsettfmceyadetativefln<br>rwitfcqsiistltHHHHHH |
| 145 | ACP101<br>IL-2<br>conjugate | mdmrvpaqllglllllwlrgarcaptssstkktqlqlehllldlqmilnginnyk<br>npkltrmltfkfympkkatelkhlqcleeelkpleevlnlaqsknfhlrprdli<br>sninvivlelkgsettfmceyadetativeflnrwitfcqsiistltSGGPGPA<br>GMKGLPGSEVQLVESGGGLVQPGNSLRLSCAASGFTFSKFGMSWVRQAPGKGLE<br>WVSSISGSGRDTLYAESVKGRFTISRDNAKTTLYLQMNSLRPEDTAVYYCTIGG<br>SLSVSSQGTLVTVSSHHHHHH |
| 146 | ACP102<br>IL-2<br>conjugate | mdmrvpaqllglllllwlrgarcQVQLQESGGGLVQAGGSLRLSCAASGRIFSID<br>IMSWYRQAPGKQRELVARITRGGTISYDDSVKGRFTISRDNAKNTVYLQMNSLK<br>PEDTGVYYCNALYGTDYWGKGTQVTVSSSGGPGPAGMKGLPGSaptssstkktq<br>lqlehllldlqmilnginnyfmceknpkltrmltfkfympkkatelkhlqclee<br>elkpleevlnlaqsknfhlrprdlisninvivlelkgsettfmceyadetativ<br>eflnrwitfcqsiistltSGGPGPAGMKGLPGSEVQLVESGGGLVQPGNSLRLS<br>CAASGFTFSKFGMSWVRQAPGKGLEWVSSISGSGRDTLYAESVKGRFTISRDNA<br>KTTLYLQMNSLRPEDTAVYYCTIGGSLSVSSQGTLVTVSSggggsggggsgggg<br>sggggsggggsggggsEVQLVESGGGLVQPGSLRLSCAASGFTFSSYTLAWVR<br>QAPGKGLEWVAAIDSSSYTYSPDTVRGRFTISRDNAKNSLYLQMNSLRAEDTAV<br>YYCARDSNWDALDYWGQGTTVTVSSGGGGSGGGGSGGGGSDIQMTQSPSSLSAS<br>VGDRVTITCKASQNVGTNVGWYQQKPGKAPKALIYSASFRYSGVPSRFSGSGSG<br>TDFTLTISSLQPEDFATYYCQQYYTYPYTFGGGTKVEIKHHHHHH |
| 147 | ACP103<br>IL-2<br>conjugate | mdmrvpaqllglllllwlrgarcaptssstkktqlqlehllldlqmilnginnyk<br>npkltrmltfkfympkkatelkhlqcleeelkpleevlnlaqsknfhlrprdli<br>sninvivlelkgsettfmceyadetativeflnrwitfcqsiistltSGGPGPA<br>GMKGLPGSggggsggggsggggsggggsggggsggggsEVQLVESGGGLVQPGG<br>SLRLSCAASGFTFSSYTLAWVRQAPGKGLEWVAAIDSSSYTYSPDTVRGRFTIS<br>RDNAKNSLYLQMNSLRAEDTAVYYCARDSNWDALDYWGQGTTVTVSSGGGGSGG<br>GGSGGGGSDIQMTQSPSSLSASVGDRVTITCKASQNVGTNVGWYQQKPGKAPKA<br>LIYSASFRYSGVPSRFSGSGSGTDFTLTISSLQPEDFATYYCQQYYTYPYTFGG<br>GTKVEIKggggsggggsggggsEVQLVESGGGLVQPGNSLRLSCAASGFTFSKF<br>GMSWVRQAPGKGLEWVSSISGSGRDTLYAESVKGRFTISRDNAKTTLYLQMNSL<br>RPEDTAVYYCTIGGSLSVSSQGTLVTVSSggggsggggsggggsQVQLQESGGG<br>LAQAGGSLSLSCAASGFTVSNSVMAWYRQTPGKQREFVAIINSVGSTNYADSVK<br>GRFTISRDNAKNTVYLQMNNLKPEDTAVYYCNRNFDRIYWGQGTQVTVSSHHHH<br>HH |

APPENDIX B-continued

Sequences

| SEQ ID NO. | Name | Sequence |
|---|---|---|
| 148 | ACP104 IL-2 conjugate | mdmrvpaqllglllllwlrgarcQVQLQESGGGLAQAGGSLSLSCAASGFTVSNS VMAWYRQTPGKQREFVAIINSVGSTNYADSVKGRFTISRDNAKNTVYLQMNNLK PEDTAVYVCNRNFDRIYWGQGTQVTVSSaptssstkktqlqlehllldlqmiln ginnyfmceknpkltrmltfkfympkkatelkhlqcleeelkpleevlnlaqsk nfhlrprdlisninvivlelkgsettfmceyadetativeflnrwitfcqsiis tltSGGPGPAGMKGLPGSEVQLVESGGGLVQPGNSLRLSCAASGFTFSKFGMSW VRQAPGKGLEWVSSISGSGRDTLYAESVKGRFTISRDNAKTTLYLQMNSLRPED TAVYYCTIGGSLSVSSQGTLVTVSSggggsggggsggggsggggsggggsgggg sEVQLVESGGGLVQPGGSLRLSCAASGFTFSSYTLAWVRQAPGKGLEWVAAIDS SSYTYSPDTVRGRFTISRDNAKNSLYLQMNSLRAEDTAVYYCARDSNWDALDYW GQGTTVTVSSGGGGSGGGGSGGGGSDIQMTQSPSSLSASVGDRVTITCKASQNV GTNVGWYQQKPGKAPKALIYSASFRYSGVPSRFSGSGSGTDFTLTISSLQPEDF ATYYCQQYTYPYTFGGGTKVEIKHHHHHH |
| 149 | ACP105 IL-2 conjugate | mdmrvpaqllglllllwlrgarcEVQLVESGGGLVQPGGSLRLSCAASGFTFSSY TLAWVRQAPGKGLEWVAAIDSSSYTYSPDTVRGRFTISRDNAKNSLYLQMNSLR AEDTAVYYCARDSNWDALDYWGQGTTVTVSSGGGGSGGGGSGGGGSDIQMTQSP SSLSASVGDRVTITCKASQNVGTNVGWYQQKPGKAPKALIYSASFRYSGVPSRF SGSGSGTDFTLTISSLQPEDFATYYCQQYTYPYTFGGGTKVEIKggggsgggg sggggsggggsggggsggggsSGGPGPAGMKGLPGSaptssstkktqlqlehll ldlqmilnginnyknpkltrmlafympkkatelkhlqcleeelkpleevlnlaq sknfhlrprdlisninvivlelkgsettfmceyadetativeflnrwitfcqsi ististltSGGPGPAGMKGLPGSEVQLVESGGGLVQPGNSLRLSCAASGFTFSKFGM SWVRQAPGKGLEWVSSISGSGRDTLYAESVKGRFTISRDNAKTTLYLQMNSLRP EDTAVYYCTIGGSLSVSSQGTLVTVSSggggsggggsggggsQVQLQESGGGLA QAGGSLSLSCAASGFTVSNSVMAWYRQTPGKQREFVAIINSVGSTNYADSVKGR FTISRDNAKNTVYLQMNNLKPEDTAVYVCNRNFDRIYWGQGTQVTVSSHHHHHH |
| 150 | ACP106 IL-2 conjugate | mdmrvpaqllglllllwlrgarcQVQLQESGGGLAQAGGSLSLSCAASGFTVSNS VMAWYRQTPGKQREFVAIINSVGSTNYADSVKGRFTISRDNAKNTVYLQMNNLK PEDTAVYVCNRNFDRIYWGQGTQVTVSSggggsggggsggggsEVQLVESGGGL VQPGNSLRLSCAASGFTFSKFGMSWVRQAPGKGLEWVSSISGSGRDTLYAESVK GRFTISRDNAKTTLYLQMNSLRPEDTAVYYCTIGGSLSVSSQGTLVTVSSSGGP GPAGMKGLPGSEVQLVESGGGLVQPGGSLRLSCAASGFTFSSYTLAWVRQAPGK GLEWVAAIDSSSYTYSPDTVRGRFTISRDNAKNSLYLQMNSLRAEDTAVYYCAR DSNWDALDYWGQGTTVTVSSGGGGSGGGGSGGGGSDIQMTQSPSSLSASVGDRV TITCKASQNVGTNVGWYQQKPGKAPKALIYSASFRYSGVPSRFSGSGSGTDFTL TISSLQPEDFATYYCQQYTYPYTFGGGTKVEIKggggsggggsggggsggggs ggggsggggsSGGPGPAGMKGLPGSaptssstkktqlqlehllldlqmilngin nyknpUtrmlafympkkatelkhlqcleeelkpleevlnlaqsknfhlrprdli sninvivlelkgsettfmceyadetativeflnrwitfcqsiistltHHHHHH |
| 151 | ACP107 IL-2 conjugate | mdmrvpaqllglllllwlrgarcEVQLVESGGGLVQPGGSLRLSCAASGFTFSSY TLAWVRQAPGKGLEWVAAIDSSSYTYSPDTVRGRFTISRDNAKNSLYLQMNSLR AEDTAVYYCARDSNWDALDYWGQGTTVTVSSGGGGSGGGGSGGGGSDIQMTQSP SSLSASVGDRVTITCKASQNVGTNVGWYQQKPGKAPKALIYSASFRYSGVPSRF SGSGSGTDFTLTISSLQPEDFATYYCQQYTYPYTFGGGTKVEIKggggsgggg sggggsggggsggggsggggsEVQLVESGGGLVQPGNSLRLSCAASGFTFSKFG MSWVRQAPGKGLEWVSSISGSGRDTLYAESVKGRFTISRDNAKTTLYLQMNSLR PEDTAVYYCTIGGSLSVSSQGTLVTVSSSGGPGPAGMKGLPGSaptssstkktq lqlehllldlqmilnginnyknpkltrmltfkfympkkatelkhlqcleeelkp leevinlaqsknfhlrprdlisninvivlelkgsettfmceyadetativefln rwitfcqsiistltggggsggggsggggsQVQLQESGGGLAQAGGSLSLSCAAS GFTVSNSVMAWYRQTPGKQREFVAIINSVGSTNYADSVKGRFTISRDNAKNTVY LQMNNLKPEDTAVYVCNRNFDRIYWGQGTQVTVSSHHHHHH |
| 152 | ACP108 IL-2 conjugate | mdmrvpaqllglllllwlrgarcQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSggggsggggsggggsaptssstkktq lqlehllldlqmilnginnyknpkltrmltfldympkkatelkhlqcleeelkp leevlnlaqsknfhlrprdlisninvivlelkgsettfmceyadetativefln rwitfcqsiistltSGGPGPAGMKGLPGSrgetgpaaPGSEVQLVESGGGLVQP GNSLRLSCAASGFTFSKFGMSWVRQAPGKGLEWVSSISGSGRDTLYAESVKGRF TISRDNAKTTLYLQMNSLRPEDTAVYYCTIGGSLSVSSQGTLVTVSSggggsgg ggsggggsggggsggggsEVQLVESGGGLVQPGGSLRLSCAASGFTFSS YTLAWVRQAPGKGLEWVAAIDSSSYTYSPDTVRGRFTISRDNAKNSLYLQMNSL RAEDTAVYYCARDSNWDALDYWGQGTTVTVSSGGGGSGGGGSGGGGSDIQMTQS PSSLSASVGDRVTITCKASQNVGTNVGWYQQKPGKAPKALIYSASFRYSGVPSR FSGSGSGTDFTLTISSLQPEDFATYYCQQYTYPYTFGGGTKVEIKHEIHHHH |
| 153 | ACP117 Anti-FN CGS-2 scFv | mdmrvpaqllglllllwlrgarcEVQLVESGGGLVQPGGSLRLSCAASGFTFSSY AMSWVRQAPGKGLEWVSAISGSGGSTYYADSVKGRFTISRDNSKNTLYLQMNSL RAEDTAVYYCARGVGAFRPYRKHEWGQGTLVTVSRggggsggggsggggsSSEL TQDPAVSVALGQTVRITCQGDSLRSYYASWYQQKPGQAPVLVIYGKNNRPSGIP |

APPENDIX B-continued

Sequences

| SEQ ID NO. | Name | Sequence |
|---|---|---|
| | | DRFSGSSSGNTASLTTTGAQAEDEADYYCNSSPFEHNLVVFGGGTKLTVLHHHH HHEPEA |
| 154 | ACP118 NARA1 Vh/Vl non-cleavable | mdmrvpaqllglllllwlrgarcQVQLQQSGAELVRPGTSVKVSCKASGYAFTNY LIEWVKQRPGQGLEWIGVINPGSGGTNYNEKFKGKATLTADKSSSTAYMQLSSL TSDDSAVYFCARWRGDGYYAYFDVWGAGTTVTVSSggggsggggsggggsDIVL TQSPASLAVSLGQRATISCKASQSVDYDGDSYMNWYQQKPGQPPKLLIYAASNL ESGIPARFSGSGSGTDFTLNIHPVEEEDAATYYCQQSNEDPYTFGGGTKLEIKH HHHHHEPEA |
| 155 | ACP119 NARA1 Vh/Vl cleavable | mdmrvpaqllglllllwlrgarcQVQLQQSGAELVRPGTSVKVSCKASGYAFTNY LIEWVKQRPGQGLEWIGVINPGSGGTNYNEKFKGKATLTADKSSSTAYMQLSSL TSDDSAVYFCARWRGDGYYAYFDVWGAGTTVTVSSSGGPGPAGMKGLPGSDIVL TQSPASLAVSLGQRATISCKASQSVDYDGDSYMNWYQQKPGQPPKLLIYAASNL ESGIPARFSGSGSGTDFTLNIHPVEEEDAATYYCQQSNEDPYTFGGGTKLEIKH HHHHHEPEA |
| 156 | ACP120 NARA1 Vl/Vh non-cleavable | mdmrvpaqllglllllwlrgarcDIVLTQSPASLAVSLGQRATISCKASQSVDYD GDSYMNWYQQKPGQPPKLLIYAASNLESGIPARFSGSGSGTDFTLNIHPVEEED AATYYCQQSNEDPYTFGGGTKLEIKggggsggggsggggsQVQLQQSGAELVRP GTSVKVSCKASGYAFTNYLIEWVKQRPGQGLEWIGVINPGSGGTNYNEKFKGKA TLTADKSSSTAYMQLSSLTSDDSAVYFCARWRGDGYYAYFDVWGAGTTVTVSSH HHHHHEPEA |
| 157 | ACP121 NARA1 Vl/Vh cleavable | mdmrvpaqllglllllwlrgarcDIVLTQSPASLAVSLGQRATISCKASQSVDYD GDSYMNWYQQKPGQPPKLLIYAASNLESGIPARFSGSGSGTDFTLNIHPVEEED AATYYCQQSNEDPYTFGGGTKLEIKSGGPGPAGMKGLPGSQVQLQQSGAELVRP GTSVKVSCKASGYAFTNYLIEWVKQRPGQGLEWIGVINPGSGGTNYNEKFKGKA TLTADKSSSTAYMQLSSLTSDDSAVYFCARWRGDGYYAYFDVWGAGTTVTVSSH HHHHHEPEA |
| 158 | ACP124 IL-2 conjugate | mdmrvpaqllglllllwlrgarcaptsssstkktqlqlehllldlqmilnginnyk npklqrmltfldympkkatelkhlqcleeelkpleevlnlaqsknfhlrprdli sninvivlelkgsettfmceyadetativeflnrwitfcqsiistltggggsgg ggsggggsEVQLVESGGGLVQPGNSLRLSCAASGFTFSKFGMSWVRQAPGKGLE WVSSISGSGRDTLYAESVKGRFTISRDNAKTTLYLQMNSLRPEDTAVYYCTIGG SLSVSSQGTLVTVSSHHHHHHEPEA |
| 159 | ACP132 IL-2 conjugate | mdmrvpaqllglllllwlrgarcaptsssstkktqlqlehllldlqmilnginnyk npkttrmItfkfympkkatelkhlqcleeelkpleevlnlaqsknfhlrprdli sninvivlelkgsettfmceyadetativeflnrwitfcqsiistltggggsgg ggsggggsdahksevahrfkdlgeenfkalvliafaqylqqcpfedhvklvnev tefaktcvadesaencdkslhtlfgdUctvatlretygemadccakqepernec flqhkddnpnlprlvrpevdvmctafhdneetflkkylyeiarrhpyfyapell ffakrykaafteccqaadkaacllpkldelrdegkassakqrlkcaslqkfger afkawavarlsqrfpkaefaevsklvtdltkvhtecchgdllecaddradlaky icenqdsissklkeccekpllekshciaevendempadlpslaadfveskdvck nyaeakdvflgmflyeyarrhpdysvvillrlaktyettlekccaaadphecya kvfdefkplveepqnlikqncelfeqlgeykfqnallvrytkkvpqvstptive vsrnlgkvgskcckhpeakrmpcaedylsvvinqlcvlhektpvsdrytkccte slvnapcfsalevdetyvpkefnaetftfhadictlsekerqikkqtalvelvk hkpkatkeqlkavmddfaafvekcckaddketcfaeegkkklvaasqaalglHHH HHEPEA |
| 160 | ACP141 IL-2 conjugate | mdmrvpaqllglllllwlrgarcaptsssstkktqlqlehllldlqmilnginnyk npkltrmltfkfympkkatelkhlqcleeelkpleevlnlaqsknfhlrprdli sninvivlelkgsettfmceyadetativeflnrwitfcqsiistltggggsgg ggsggggsdahksevahrfkdlgeenfkalvliafaqylqqcpfedhvklvnev tefaktcvadesaencdkslhtlfgdUctvatlretygemadccakqepernec flqhkddnpnlprlvrpevdvmctafhdneetflkkylyeiarrhpyfyapell ffakrykaafteccqaadkaacllpkldelrdegkassakqrlkcaslqkfger afkawavarlsqrfpkaefaevsklvtdltkvhtecchgdllecaddradlaky icenqdsissklkeccekpllekshciaevendempadlpslaadfveskdvck nyaeakdvflgmflyeyarrhpdysvvillrlaktyettlekccaaadphecya kvfdefkplveepqnlikqncelfeqlgeykfqnallvrytkkvpqvstptive vsrnlgkvgskcckhpeakrmpcaedylsvvinqlcvlhektpvsdrytkccte slvnapcfsalevdetyvpkefnaetftfhadictlsekerqikkqtalvelvk hkpkatkeqlkavmddfaafvekcckaddketcfaeegkkklvaasqaalglHHH HHEPEA |
| 161 | ACP142 IL-2 conjugate | mdmrvpaqllglllllwlrgarcaptsssstkktqlqlehllldlqmilnginnyk npkltrmltfkfympkkatelkhlqcleeelkpleevlnlaqsknfhlrprdli sninvivlelkgsettfmceyadetativeflnrwitfcqsiistltSGGPGPA GMKGLPGSdahksevahrfkdlgeenfkalvliafaqylqqcpfedhvklvnev tefaktcvadesaencdkslhtlfgdklctvaftretygemadccakqeperne |

APPENDIX B-continued

Sequences

| SEQ ID NO. | Name | Sequence |
|---|---|---|
| | | cflqhkddnpnlprlvrpevdvmctafhdneetflkkylyeiarrhpyfyapel lffakrykaafteccqaadkaacllpkldelrdegkassakqrlkcaslqkfge rafkawavarlsqrfpkaefaevsklvtdltkvhtecchgdllecaddradlak yicenqdsisssklkeccekpllekshciaevendempadlpslaadfveskdvc knyaeakdvflgmflyeyarrhpdysvvillrlaktyettlekccaaadphecy akvfdefkplveepqnlikqncelfeqlgeykfqnallvrytkkvpqvstptiv evsrnlgkvgskccchpeakrmpcaedylsvvinqlcvlhektpvsdrvtkcct eslvnapcfsalevdetyvpkefnaetftfhadictlsekerqikkqtalvelv khhkpkatkeqlkavmddfaafvekcckaddketcfaeegkklvaasqaalglHH HHHEPEA |
| 162 | ACP144 IL-2 conjugate | mdmrvpaqllglllllwlrgarcaptssstkktqlqlehllldlqmilnginnyk npkltrmltfkfympkkatelkhlqcleeeelkpleevlnlaqsknfhlrprdli sninvivlelkgsettfmceyadetativeflnrwitfcqsiistltSGGPGPA GMKGLPGSEVQLVESGGGLVQPGNSLRLSCAASGFTFSKFGMSWVRQAPGKGLE WVSSISGSGRDTLYAESVKGRFTISRDNAKTTLYLQMNSLRPEDTAVYYCTIGG SLSVSSQGTLVTVSSggggsggggsggggsggggsggggsggggsSGGPGPAGM KGLPGSEVQLVESGGGLVQPGGSLRLSCAASGFTFSSYTLAWVRQAPGKGLEWV AAIDSSSYTYSPDTVRGRFTISRDNAKNSLYLQMNSLRAEDTAVYYCARDSNWD ALDYWGQGTTVTVSSGGGGSGGGGSGGGGSDIQMTQSPSSLSASVGDRVTITCK ASQNVGTNVGWYQQKPGKAPKALIYSASFRYSGVPSRFSGSGSGTDFTLTISSL QPEDFATYYCQQYYTYPYTFGGGTKVEIKggggsggggsggggsQVQLQESGGG LAQAGGSLSLSCAASGFTVSNSVMAWYRQTPGKQREFVAIINSVGSTNYADSVK GRFTISRDNAKNTVYLQMNNLKPEDTAVYVCNRNFDRIYWGQGTQVTVSSHHHH HHEPEA |
| 163 | ACP145 IL-2 conjugate | mdmrvpaqllglllllwlrgarcQVQLQESGGGLAQAGGSLSLSCAASGFTVSNS VMAWYRQTPGKQREFVAIINSVGSTNYADSVKGRFTISRDNAKNTVYLQMNNLK PEDTAVYVCNRNFDRIYWGQGTQVTVSSggggsggggsggggsggggsstkktq lqlehllldlqmilnginnyfmceknpkltrmltfkfympkkatelkhlqclee elkpleevlnlaqsknfhlrprdlisninvivlelkgsettfmceyadetativ eflnrwitfcqsiistltSGGPGPAGMKGLPGSEVQLVESGGGLVQPGNSLRLS CAASGFTFSKFGMSWVRQAPGKGLEWVSSISGSGRDTLYAESVKGRFTISRDNA KTTLYLQMNSLRPEDTAVYYCTIGGSLSVSSQGTLVTVSSggggsggggsgggg sggggsggggsggggsSGGPGPAGMKGLPGSEVQLVESGGGLVQPGGSLRLSCA ASGFTFSSYTLAWVRQAPGKGLEWVAAIDSSSYTYSPDTVRGRFTISRDNAKNS LYLQMNSLRAEDTAVYYCARDSNWDALDYWGQGTTVTVSSGGGGSGGGGSGGGG SDIQMTQSPSSLSASVGDRVTITCKASQNVGTNVGWYQQKPGKAPKALIYSASF RYSGVPSRFSGSGSGTDFTLTISSLQPEDFATYYCQQYYTYPYTFGGGTKVEIK HHHHHHEPEA |
| 164 | ACP146 IL-2 conjugate | mdmrvpaqllglllllwlrgarcQVQLQESGGGLAQAGGSLSLSCAASGFTVSNS VMAWYRQTPGKQREFVAIINSVGSTNYADSVKGRFTISRDNAKNTVYLQMNNLK PEDTAVYVCNRNFDRIYWGQGTQVTVSSSGGPGPAGMKGLPGSaptssstkktq lqlehllldlqmilnginnyknpkltrmltfkfympkkatelkhlqcleeeelkp leevlnlaqsknfhlrprdlisninvivlelkgsettfmceyadetativefln rwitfcqsiistltSGGPGPAGMKGLPGSEVQLVESGGGLVQPGNSLRLSCAAS GFTFSKFGMSWVRQAPGKGLEWVSSISGSGRDTLYAESVKGRFTISRDNAKTTL YLQMNSLRPEDTAVYYCTIGGSLSVSSQGTLVTVSSggggsggggsggggsggg gsggggsggggsSGGPGPAGMKGLPGSEVQLVESGGGLVQPGGSLRLSCAASGF TFSSYTLAWVRQAPGKGLEWVAAIDSSSYTYSPDTVRGRFTISRDNAKNSLYLQ MNSLRAEDTAVYYCARDSNWDALDYWGQGTTVTVSSGGGGSGGGGSGGGGSDIQ MTQSPSSLSASVGDRVTITCKASQNVGTNVGWYQQKPGKAPKALIYSASFRYSG VPSRFSGSGSGTDFTLTISSLQPEDFATYYCQQYYTYPYTFGGGTKVEIKHHHH HHEPEA |
| 165 | ACP133 IL-2-6xHis | mdmrvpaqllglllllwlrgarcaptssstkktqlqlehllldlqmilnginnyk npkltrmltfkfympkkatelkhlqcleeeelkpleevlnlaqsknfhlrprdli sninvivlelkgsettfmceyadetativeflnrwitfcqsnstltHHHHHH |
| 166 | ACP147 IL-2 conjugate | mdmrvpaqllglllllwlrgarcaptssstkktqlqlehllldlqmilnginnyk npkltrmltfkfympkkatelkhlqcleeeelkpleevlnlaqsknfhlrprdli sninvivlelkgsettfmceyadetativeflnrwitfcqsiistltSGGPGPA GMKGLPGSEVQLVESGGGLVQPGNSLRLSCAASGFTFSKFGMSWVRQAPGKGLE WVSSISGSGRDTLYAESVKGRFTISRDNAKTTLYLQMNSLRPEDTAVYYCTIGG SLSVSSQGTLVTVSSggggsggggsggggsggggsggggsggggsSGGPGPAGM KGLPGSEVQLVESGGGLVQPGGSLRLSCAASGFTFSSYTLAWVRQAPGKGLEWV AAIDSSSYTYSPDTVRGRFTISRDNAKNSLYLQMNSLRAEDTAVYYCARDSNWD ALDYWGQGTTVTVSSGGGGSGGGGSGGGGSDIQMTQSPSSLSASVGDRVTITCK ASQNVGTNVGWYQQKPGKAPKALIYSASFRYSGVPSRFSGSGSGTDFTLTISSL QPEDFATYYCQQYYTYPYTFGGGTKVEIKggggsggggsggggsQVQLQESGGG LVQAGGSLRLSCAASGRIFSIDIMSWYRQAPGKQRELVARITRGGTISYDDSVK GRFTISRDNAKNTVYLQMNSLKPEDTGVYYCNALYGTDYWGKGTQVTVSSHHHH HHEPEA |

APPENDIX B-continued

Sequences

| SEQ ID NO. | Name | Sequence |
|---|---|---|
| 167 | ACP148 IL-2 conjugate | mdmrvpaqllglllwlrgarcQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSggggsggggsggggsaptssstkktq lqlehllldlqmilnginnyknpkltrmltfkfympkkatelkhlqcleeelkp leevlnlaqsknfhlrprdlisninivivlelkgsettfmceyadetativefln rwitfcqsiistltSGGPGPAGMKGLPGSEVQLVESGGGLVQPGNSLRLSCAAS GFTFSKFGMSWVRQAPGKGLEWVSSISGSGRDTLYAESVKGRFTISRDNAKTTL YLQMNSLRPEDTAVYYCTIGGSLSVSSQGTLVTVSSggggsggggsggggsggg gsggggsggggsSGGPGPAGMKGLPGSEVQLVESGGGLVQPGGSLRLSCAASGF TFSSYTLAWVRQAPGKGLEWVAAIDSSSYTYSPDTVRGRFTISRDNAKNSLYLQ MNSLRAEDTAVYYCARDSNWDALDYWGQGTTVTVSSGGGGSGGGGSGGGGSDIQ MTQSPSSLSASVGDRVTITCKASQNVGTNVGWYQQKPGKAPKALIYSASFRYSG VPSRFSGSGSGTDFTLTISSLQPEDFATYYCQQYTYPYTFGGGTKVEIKHHHH HHEPEA |
| 168 | ACP149 IL-2 conjugate | mdmrvpaqllglllwlrgarcQVQLQESGGGLVQAGGSLRLSCAASGRIFSID IMSWYRQAPGKQRELVARITRGGTISYDDSVKGRFTISRDNAKNTVYLQMNSLK PEDTGVYYCNALYGTDYWGKGTQVTVSSSGGPGPAGMKGLPGSaptssstkktq lqlehllldlqmilnginnyknpkltrmltfkfympkkatelkhlqcleeelkp leevlnlaqsknfhlrprdlisninivivlelkgsettfmceyadetativefln rwitfcqsiistltSGGPGPAGMKGLPGSEVQLVESGGGLVQPGNSLRLSCAAS GFTFSKFGMSWVRQAPGKGLEWVSSISGSGRDTLYAESVKGRFTISRDNAKTTL YLQMNSLRPEDTAVYYCTIGGSLSVSSQGTLVTVSSggggsggggsggggsggg gsggggsggggsSGGPGPAGMKGLPGSEVQLVESGGGLVQPGGSLRLSCAASGF TFSSYTLAWVRQAPGKGLEWVAAIDSSSYTYSPDTVRGRFTISRDNAKNSLYLQ MNSLRAEDTAVYYCARDSNWDALDYWGQGTTVTVSSGGGGSGGGGSGGGGSDIQ MTQSPSSLSASVGDRVTITCKASQNVGTNVGWYQQKPGKAPKALIYSASFRYSG VPSRFSGSGSGTDFTLTISSLQPEDFATYYCQQYTYPYTFGGGTKVEIKHHHH HHEPEA |
| 169 | ACP33 Mouse IFNa-conjugate | mdmrvpaqllglllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGSEVQLVESGGGLVQPGNSLRLSCAASGFTFSKFGMSWVRQAPGKGLEWVSSISGSG RDTLYAESVKGRFTISRDNAKTTLYLQMNSLRPEDTAVYYCTIGGSLSVSSQGT LVTVSSHHHHHHEPEA |
| 170 | ACP131 Mouse IFNa | mdmrvpaqllglllwlrgarccdlpqthnlmkraltllvqmalsplsclkdrk dfgfpqekvdaqqikkaqaipvlseltqqflniftskdssaawnttlldsfcnd lhqqlndlqgclmqqvgvqefpltqedallavrkyfhntlrekkhspcawevvr aevwralsssanvlgrlreekHHHHHEPEA |
| 171 | ACP125 Mouse IFNa-conjugate | mdmrvpaqllglllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGScdlpqthnlm kraltllvqmalsplsclkdrkdfgfpqekvdaqqikkagaipvlseltqqiln iftskdssaawntfildsfcndlhqqlndlqgclmqqvgvqefpltqedallav rkyfhrinTylrekkhspcawevvraevwralsssanvlgrlreekHHHHHHEP EA |
| 172 | ACP126 Mouse IFNa-conjugate | mdmrvpaqllglllwlrgarccdlpqthnlmkraltllvqmalsplsclkdrk dfgfpqekvdaqqikkaqaipvlseltqqflniftskdssaawnttlldsfcnd lhqqlndlqgclmqqvgvqefpltqedallavrkyfhritvylrekkhspcawe vvraevwralsssanvlgrlreekSGGPGPAGMKGLPGSEVQLVESGGGLVQPG NSLRLSCAASGFTFSKFGMSWVRQAPGKGLEWVSSISGSGRDTLYAESVKGRFT ISRDNAKTTLYLQMNSLRPEDTAVYYCTIGGSLSVSSQGTLVTVSSHHHHHHEP EA |
| 173 | ACP127 Mouse IFNa-conjugate | mdmrvpaqllglllwlrgarcEAHKSEIAHRYNDLGEQHFKGLVLIAFSQYLQ KCSYDEHAKLVQEVTDFAKTCVADESAANCDKSLHTLFGDKLCAIPNLRENYGE LADCCTKQEPERNECFLQHKDDNPSLPPFERPEAEAMCTSFKENPTTFMGHYLH EVARRHPYFYAPELLYYAEQYNEILTQCCAEADKESCLTPKLDGVKEKALVSSV RQRMKCSSMQKFGERAFKAWAVARLSQTFPNADFAEITKLATDLTKVNKECCHG DLLECADDRAELAKYMCENQATISSKLQTCCDKPLLKKAHCLSEVEHDTMPADL PAIAADFVEDQEVCKNYAEAKDVFLGTFLYEYSRRHPDYSVSLLLRLAKKYEAT LEKCCAEANPPACYGTVLAEFQPLVEEPKNLVKTNCDLYEKLGEYGFQNAILVR YTQKAPQVSTPTLVEAARNLGRVGTKCCTLPEDQRLPCVEDYLSAILNRVCLLH EKTPVSEHVTKCCSGSLVERRPCFSALTVDETYVPKEFKAETFTFHSDICTLPE KEKQIKKQTALAELVKHKPKATAEQLKTVMDDFAQFLDTCCKAADKDTCFSTEG PNLVTRCKDALASGGPGPAGMKGLPGScdlpqthnlmkraltllvqmalsplsc lkdrkdfgfpqekvdaqqikkaqaipvlseltqqilniftskdssaawntfild sfendlhqqlndlqgclmqqvgvqefpltqedallavrkyfhrityylrekkhs |

APPENDIX B-continued

Sequences

| SEQ ID NO. | Name | Sequence |
|---|---|---|
| | | pcawevvraevwralsssanvlgrlreekSGGPGPAGMKGLPGSEAHKSEIAHR YNDLGEQHFKGLVLIAFSQYLQKCSYDEHAKLVQEVTDFAKTCVADESAANCDK SLHTLFGDKLCAIPNLRENYGELADCCTKQEPERNECFLQHKDDNPSLPPFERP EAEAMCTSFKENPTTFMGHYLHEVARRHPYFYAPELLYYAEQYNEILTQCCAEA DKESCLTPKLDGVKEKALVSSVRQRMKCSSMQKFGERAFKAWAVARLSQTFPNA DFAEITKLATDLTKVNKECCHGDLLECADDRAELAKYMCENQATISSKLQTCCD KPLLKKAHCLSEVEHDTMPADLPAIAADFVEDQEVCKNYAEAKDVFLGTFLYEY SRRHPDYSVSLLLRLAKKYEATLEKCCAEANPPACYGTVLAEFQPLVEEPKNLV KTNCDLYEKLGEYGFQNAILVRYTQKAPQVSTPTLVEAARNLGRVGTKCCTLPE DQRLPCVEDYLSAILNRVCLLHEKTPVSEHVTKCCSGSLVERRPCFSALTVDET YVPKEFKAETFTFHSDICTLPEKEKQIKKQTALAELVKHKPKATAEQLKTVMDD FAQFLDTCCKAADKDTCFSTEGPNLVTRCKDALAHHHHHHEPEA |
| 174 | ACP128 Mouse IFNa-conjugate | mdmrvpaqllglllwlrgarcEAHKSEIAHRYNDLGEQHFKGLVLIAFSQYLQ KCSYDEHAKLVQEVTDFAKTCVADESAANCDKSLHTLFGDKLCAIPNLRENYGE LADCCTKQEPERNECFLQHKDDNPSLPPFERPEAEAMCTSFKENPTTFMGHYLH EVARRHPYFYAPELLYYAEQYNEILTQCCAEADKESCLTPKLDGVKEKALVSSV RQRMKCSSMQKFGERAFKAWAVARLSQTFPNADFAEITKLATDLTKVNKECCHG DLLECADDRAELAKYMCENQATISSKLQTCCDKPLLKKAHCLSEVEHDTMPADL PAIAADFVEDQEVCKNYAEAKDVFLGTFLYEYSRRHPDYSVSLLLRLAKKYEAT LEKCCAEANPPACYGTVLAEFQPLVEEPKNLVKTNCDLYEKLGEYGFQNAILVR YTQKAPQVSTPTLVEAARNLGRVGTKCCTLPEDQRLPCVEDYLSAILNRVCLLH EKTPVSEHVTKCCSGSLVERRPCFSALTVDETYVPKEFKAETFTFHSDICTLPE KEKQIKKQTALAELVKHKPKATAEQLKTVMDDFAQFLDTCCKAADKDTCFSTEG PNLVTRCKDALASGGPGPAGMKGLPGScdlpqthnlmkraltllvqmalsplsc lkdrkdfgfpqekvdaqqikkaqaipvlseltqqilniftskdssaawntfild sfendlhqqlndlqgclmqqvgvqefpltqedallavrkyfhrityylrekkhs pcawevvraevwralsssanvlgrlreekHHHHHHEPEA |
| 175 | ACP129 Mouse IFNa-conjugate | mdmrvpaqllglllwlrgarccdlpqthnlmkraltllvqmalsplsclkdrk dfgfpqekvdaqqikkaqaipvlseltqqilniftskdssaawnttlldsfend lhqqlndlqgclmqqvgvqefpltqedallavrkyfhritvylrekkhspcawe vvraevwralsssanvlgrlreekSGGPGPAGMKGLPGSEAHKSEIAHRYNDLG EQHFKGLVLIAFSQYLQKCSYDEHAKLVQEVTDFAKTCVADESAANCDKSLHTL FGDKLCAIPNLRENYGELADCCTKQEPERNECFLQHKDDNPSLPPFERPEAEAM CTSFKENPTTFMGHYLHEVARRHPYFYAPELLYYAEQYNEILTQCCAEADKESC LTPKLDGVKEKALVSSVRQRMKCSSMQKFGERAFKAWAVARLSQTFPNADFAEI TKLATDLTKVNKECCHGDLLECADDRAELAKYMCENQATISSKLQTCCDKPLLK KAHCLSEVEHDTMPADLPAIAADFVEDQEVCKNYAEAKDVFLGTFLYEYSRRHP DYSVSLLLRLAKKYEATLEKCCAEANPPACYGTVLAEFQPLVEEPKNLVKTNCD LYEKLGEYGFQNAILVRYTQKAPQVSTPTLVEAARNLGRVGTKCCTLPEDQRLP CVEDYLSAILNRVCLLHEKTPVSEHVTKCCSGSLVERRPCFSALTVDETYVPKE FKAETFTFHSDICTLPEKEKQIKKQTALAELVKHKPKATAEQLKTVMDDFAQFL DTCCKAADKDTCFSTEGPNLVTRCKDALAHHHHHHEPEA |
| 176 | ACP150 Mouse IFNa-conjugate | mdmrvpaqllglllwlrgarcQVQLQESGGGLAQAGGSLSLSCAASGFTVSNS VMAWYRQTPGKQREFVAIINSVGSTNYADSVKGRFTISRDNAKNTVYLQMNNLK PEDTAVYVCNRNFDRIYWGQGTQVTVSSggggsggggsggggsEVQLVESGGGL VQPGNSLRLSCAASGFTFSKFGMSWVRQAPGKGLEWVSSISGSGRDTLYAESVK GRFTISRDNAKTTLYLQMNSLRPEDTAVYYCTIGGSLSVSSQGTLVTVSSSGGP GPAGMKGLPGScdlpqthnlmkraltllvqmalsplsclkdrkdfgfpqekvda qqikkaqaipvlseltqqilniftskdssaawnttlldsfcndlhqqlndlqgc lmqqvgvqefpltqedallavrkyfhrityylrekkhspcawevvraevwrals sssanvlgrlreekSGGPGPAGMKGLPGSEVQLVESGGGLVQPGNSLRLSCAASG FTFSKFGMSWVRQAPGKGLEWVSSISGSGRDTLYAESVKGRFTISRDNAKTTLY LQMNSLRPEDTAVYYCTIGGSLSVSSQGTLVTVSSHHHHHHEPEA |
| 177 | ACP151 Mouse IFNa-conjugate | mdmrvpaqllglllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSSGGPGPAGMKGLPGScdlpqthnlm kraltllvqmalsplsclkdrkdfgfpqekvdaqqikkaqaipvlseltqqiln iftskdssaawntfildsfcndlhqqlndlqgclmqqvgvqefpltqedallav rkyfhritvylrekkhspcawevvraevwralsssanvlgrlreekSGGPGPAG MKGLPGSEVQLVESGGGLVQPGNSLRLSCAASGFTFSKFGMSWVRQAPGKGLEW VSSISGSGRDTLYAESVKGRFTISRDNAKTTLYLQMNSLRPEDTAVYYCTIGGS LSVSSQGTLVTVSSggggsggggsggggsQVQLQESGGGLAQAGGSLSLSCAAS GFTVSNSVMAWYRQTPGKQREFVAIINSVGSTNYADSVKGRFTISRDNAKNTVY LQMNNLKPEDTAVYVCNRNFDRIYWGQGTQVTVSSHHHHHHEPEA |
| 178 | ACP152 Mouse IFNa-conjugate | mdmrvpaqllglllwlrgarcEVQLVESGGGLVQPGNSLRLSCAASGFTFSKF GMSWVRQAPGKGLEWVSSISGSGRDTLYAESVKGRFTISRDNAKTTLYLQMNSL RPEDTAVYYCTIGGSLSVSSQGTLVTVSSggggsggggsggggscdlpqthnlr nkraltllvqmalsplsclkdrkdfgfpqekvdaqqikkaqaipvlseltqqil |

APPENDIX B-continued

Sequences

| SEQ ID NO. | Name | Sequence |
|---|---|---|
| | | niftskdssaawnttlldsfcndlhqqlndlqgclmqqvgvqefpltqedalla vrkyfhritvylrekkhspcawevvraevwralsssanvlgrlreekggggsgg ggsggggsEVQLVESGGGLVQPGNSLRLSCAASGFTFSKFGMSWVRQAPGKGLE WVSSISGSGRDTLYAESVKGRFTISRDNAKTTLYLQMNSLRPEDTAVYYCTIGG SLSVSSQGTLVTVSSHHHHHHEPEA |
| 179 | ACP153 (IL-2 Conjugate) | mdmrvpaqllglllllwlrgarcaptssstkktqlqlehllldlqmilnginnyk npkltrmltfkfympkkatelkhlqcleeeelkpleevlnlaqsknfhlrprdli sninvivlelkgsettfmceyadetativeflnrwitfcqsiistltsggpGPA GLYAQpgsEVQLVESGGGLVQPGNSLRLSCAASGFTFSKFGMSWVRQAPGKGLE WVSSISGSGRDTLYAESVKGRFTISRDNAKTTLYLQMNSLRPEDTAVYYCTIGG SLSVSSQGTLVTVSSggggsggggsggggsggggsggggsggggsggggssggpGPAGL YAQpgsEVQLVESGGGLVQPGGSLRLSCAASGFTFSSYTLAWVRQAPGKGLEWV AAIDSSSYTYSPDTVRGRFTISRDNAKNSLYLQMNSLRAEDTAVYYCARDSNWD ALDYWGQGTTVTVSSGGGGSGGGGSGGGGSDIQMTQSPSSLSASVGDRVTITCK ASQNVGTNVGWYQQKPGKAPKALIYSASFRYSGVPSRFSGSGSGTDFTLTISSL QPEDFATYYCQQYYTYPYTFGGGTKVEIKHHHHHHEPEA |
| 180 | ACP154 (IL-2 Conjugate) | mdmrvpaqllglllllwlrgareaptssstkktqlqlehllldlqmilnginnyk npkltrmltfkfympkkatelkhlqeleeeelkpleevlnlaqsknfhlrprdli sninvivlelkgsettfmeeyadetativeflnrwitfeqsiistltsggpPGG PAGIGpgsEVQLVESGGGLVQPGNSLRLSCAASGFTFSKFGMSWVRQAPGKGLE WVSSISGSGRDTLYAESVKGRFTISRDNAKTTLYLQMNSLRPEDTAVYYCTIGG SLSVSSQGTLVTVSSggggsggggsggggsggggsggggsggggsggggssggpPGGPA GIGpgsEVQLVESGGGLVQPGGSLRLSCAASGFTFSSYTLAWVRQAPGKGLEWV AAIDSSSYTYSPDTVRGRFTISRDNAKNSLYLQMNSLRAEDTAVYYCARDSNWD ALDYWGQGTTVTVSSGGGGSGGGGSGGGGSDIQMTQSPSSLSASVGDRVTITCK ASQNVGTNVGWYQQKPGKAPKALIYSASFRYSGVPSRFSGSGSGTDFTLTISSL QPEDFATYYCQQYYTYPYTFGGGTKVEIKHHHHHHEPEA |
| 181 | ACP155 (IL-2 Conjugate) | mdmrvpaqllglllllwlrgareaptssstkktqlqlehllldlqmilnginnyk npkltrmltfkfympkkatelkhlqeleeeelkpleevlnlaqsknfhlrprdli sninvivlelkgsettfmeeyadetativeflnrwitfeqsiistltsggpALF KSSFPpgsEVQLVESGGGLVQPGNSLRLSCAASGFTFSKFGMSWVRQAPGKGLE WVSSISGSGRDTLYAESVKGRFTISRDNAKTTLYLQMNSLRPEDTAVYYCTIGG SLSVSSQGTLVTVSSggggsggggsggggsggggsggggsggggsggggssggpALFKS SFPpgsEVQLVESGGGLVQPGGSLRLSCAASGFTFSSYTLAWVRQAPGKGLEWV AAIDSSSYTYSPDTVRGRFTISRDNAKNSLYLQMNSLRAEDTAVYYCARDSNWD ALDYWGQGTTVTVSSGGGGSGGGGSGGGGSDIQMTQSPSSLSASVGDRVTITCK ASQNVGTNVGWYQQKPGKAPKALIYSASFRYSGVPSRFSGSGSGTDFTLTISSL QPEDFATYYCQQYYTYPYTFGGGTKVEIKHHHHHHEPEA |
| 182 | ACP156 (IL-2 Conjugate) | mdmrvpaqllglllllwlrgareaptssstkktqlqlehllldlqmilnginnyk npkltrmltfkfympkkatelkhlqeleeeelkpleevlnlaqsknfhlrprdli sninvivlelkgsettfmeeyadetativeflnrwitfeqsiistltsggpPLA QKLKSSpgsEVQLVESGGGLVQPGNSLRLSCAASGFTFSKFGMSWVRQAPGKGL EWVSSISGSGRDTLYAESVKGRFTISRDNAKTTLYLQMNSLRPEDTAVYYCTIG GSLSVSSQGTLVTVSSggggsggggsggggsggggsggggsggggsggggssggpPLAQ KLKSSpgsEVQLVESGGGLVQPGGSLRLSCAASGFTFSSYTLAWVRQAPGKGLE WVAAIDSSSYTYSPDTVRGRFTISRDNAKNSLYLQMNSLRAEDTAVYYCARDSN WDALDYWGQGTTVTVSSGGGGSGGGGSGGGGSDIQMTQSPSSLSASVGDRVTIT CKASQNVGTNVGWYQQKPGKAPKALIYSASFRYSGVPSRFSGSGSGTDFTLTIS SLQPEDFATYYCQQYYTYPYTFGGGTKVEIKHHHHHHEPEA |
| 183 | ACP157 (IL-2 Conjugate) | mdmrvpaqllglllllwlrgareaptssstkktqlqlehllldlqmilnginnyk npkltrmltfkfympkkatelkhlqeleeeelkpleevlnlaqsknfhlrprdli sninvivlelkgsettfmeeyadetativeflnrwitfeqsiistltsggpPGG PAGIGalfkssfpPLAQKLKSSpgsEVQLVESGGGLVQPGNSLRLSCAASGFTF SKFGMSWVRQAPGKGLEWVSSISGSGRDTLYAESVKGRFTISRDNAKTTLYLQM NSLRPEDTAVYYCTIGGSLSVSSQGTLVTVSSggggsggggsggggsggggsgg ggsggggssggpPGGPAGIGalfkssfpPLAQKLKSSpgsEVQLVESGGGLVQP GGSLRLSCAASGFTFSSYTLAWVRQAPGKGLEWVAAIDSSSYTYSPDTVRGRFT ISRDNAKNSLYLQMNSLRAEDTAVYYCARDSNWDALDYWGQGTTVTVSSGGGGS GGGGSGGGGSDIQMTQSPSSLSASVGDRVTITCKASQNVGTNVGWYQQKPGKAP KALIYSASFRYSGVPSRFSGSGSGTDFTLTISSLQPEDFATYYCQQYYTYPYTFG GGTKVEIKHHHHHHEPEA |
| 184 | | Place hold |
| 185 | | Place hold |
| 186 | | Place hold |
| 187 | | Place hold |

APPENDIX B-continued

Sequences

| SEQ ID NO. | Name | Sequence |
|---|---|---|
| 188 | | Place hold |
| 189 | | Place hold |
| 190 | | Place hold |
| 191 | | Place hold |
| 192 | Blocker2 (IL2 blocker)T | mdmrvpaqllglllllwlrgarcEVQLVESGGGLVQPGGSLRLSCAASGFTFSSY LAWVRQAPGKGLEWVAAIDSSSYTYSPDTVRGRFTISRDNAKNSLYLQMNSLRA EDTAVYYCARDSNWDALDYWGQTTVTVSSggggsggggsggggsDIQMTQSPS SLSASVGDRVTITCKASQNVGTNVGWYQQKPGKAPKALIYSASFRYSGVPSRFS GSGSGTDFTLTISSLQPEDFATYYCQQYYTYPYTFGGGTKVEIKHHHHHH |
| 193 | Blocker12 (IL-12 blocker) | mdmrvpaqllglllllwlrgarcQSVLTQPPSVSGAPGQRVTISCSGSRSNIGSN TVKWYQQLPGTAPKLLIYYNDQRPSGVPDRFSGSKSGTSASLAITGLQAEDEAD YYCQSYDRYTHPALLFGTGTKVTVLggggsggggsggggsQVQLVESGGGVVQP GRSLRLSCAASGFTFSSYGMHWVRQAPGKGLEWVAFIRYDGSNKYYADSVKGRF TISRDNSKNTLYLQMNSLRAEDTAVYYCKTHGSHDNWGQGTMVTVSSFIRREIH H |
| 194 | | EVQLVESGGGLVQPGNSLRLSCAASGFTFSKFGMSWVRQGGGGGLDGNEEPGGL EWVSSISGSGRDTLYADSVKGRFTISRDNAKTTLYLQMNSLRPEDTAVYYCTIG GSLSVSSQGTLVTVSS |
| 225 | ACP203 | EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSsggpGPAGLYAQpgscdlpqthnlrnkraltllvqmrrlsplsclkd rkdfgfpqekvdaqqikkaqaipvlseltqqilniftskdssaawnttlldsfc ndlhqqlndlqgclmqqvgvqefpltqedallavrkyfhritvylrekkhspca wevvraeywralsssanylgrlreeksggpGPAGLYAQpgsEVQLVESGGGLVQ PGNSLRLSCAASGFTFSKFGMSWVRQAPGKGLEWVSSISGSGRDTLYAESVKGR FTISRDNAKTTLYLQMNSLRPEDTAVYYCTIGGSLSVSSQGTLVTVSS |
| 226 | ACP204 | EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSsggpALFKSSFPpgscdlpqthnlrnkraltllvqmrrlsplsclkd rkdfgfpqekvdaqqikkaqaipvlseltqqilniftskdssaawnttlldsfc ndlhqqlndlqgclmqqvgvqefpltqedallavrkyfhrityylrekkhspca wevvraeywralsssanylgrlreeksggpALFKSSFPpgsEVQLVESGGGLVQ PGNSLRLSCAASGFTFSKFGMSWVRQAPGKGLEWVSSISGSGRDTLYAESVKGR FTISRDNAKTTLYLQMNSLRPEDTAVYYCTIGGSLSVSSQGTLVTVSS |
| 227 | ACP205 | EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSsggpPLAQKLKSSpgscdlpqthnlrnkraltllvqmrrlsplsclk drkdfgfpqekvdaqqikkaqaipvlseltqqilniftskdssaawnttlldsf cndlhqqlndlqgclmqqvgvqefpltqedallavrkyfhritvylrekkhspc awevvraeywralsssanylgrlreeksggpPLAQKLKSSpgsEVQLVESGGGL VQPGNSLRLSCAASGFTFSKFGMSWVRQAPGKGLEWVSSISGSGRDTLYAESVK GRFTISRDNAKTTLYLQMNSLRPEDTAVYYCTIGGSLSVSSQGTLVTVSS |
| 228 | ACP206 | EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSsggpGPAGLYAQpgscdlpqthslgsrrtlmllaqmrrislfsclkd rhdfgfpqeefgnqfqkaetipvlhemiqqifnlfstkdssaawdetlldkfyt elyqqlndleacviqgvgytetplmkedsilayrkyfqritlylkekkyspcaw evvraeimrsfslstnlqeslrskesggpGPAGLYAQpgsEVQLVESGGGLVQP GNSLRLSCAASGFTFSKFGMSWVRQAPGKGLEWVSSISGSGRDTLYAESVKGRF TISRDNAKTTLYLQMNSLRPEDTAVYYCTIGGSLSVSSQGTLVTVSS |
| 229 | ACP207 | EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSsggpALFKSSFPpgscdlpqthslgsrrtlmllaqmrrislfsclkd rhdfgfpqeefgnqfqkaetipvlhemiqqifnlfstkdssaawdetlldkfyt elyqqlndleacviqgvgytetplmkedsilayrkyfqritlylkekkyspcaw evvraeimrsfslstnlqeslrskesggpALFKSSFPpgsEVQLVESGGGLVQP GNSLRLSCAASGFTFSKFGMSWVRQAPGKGLEWVSSISGSGRDTLYAESVKGRF TISRDNAKTTLYLQMNSLRPEDTAVYYCTIGGSLSVSSQGTLVTVSS |
| 230 | ACP208 | EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQG TLVTVSSsggpPLAQKLKSSpgscdlpqthslgsrrtlmllaqmrrislfsclk drhdfgfpqeefgnqfqkaetipvlhemiqqifnlfstkdssaawdetlldkfy telyqqlndleacviqgvgytetplmkedsilayrkyfqritlylkekkyspca |

APPENDIX B-continued

Sequences

| SEQ ID NO. | Name | Sequence |
|---|---|---|
| | | wevvraeimrsfslstnlqeslrskesggpPLAQKLKSSpgsEVQLVESGGGLV QPGNSLRLSCAASGFTFSKFGMSWVRQAPGKGLEWVSSISGSGRDTLYAESVKG RFTISRDNAKTTLYLQMNSLRPEDTAVYYCTIGGSLSVSSQGTLVTVSS |
| 258 | MMP14 substrate motif sequence | GPLGLKAQ |
| 259 | MMP14 substrate motif sequence | LPLGLKAQ |
| 260 | MMP14 substrate motif sequence | SPLGLKAQ |
| 261 | MMP14 substrate motif sequence | QPLGLKAQ |
| 262 | MMP14 substrate motif sequence | KPLGLKAQ |
| 263 | MMP14 substrate motif sequence | FPLGLKAQ |
| 264 | MMP14 substrate motif sequence | HPLGLKAQ |
| 265 | MMP14 substrate motif sequence | PPLGLKAQ |
| 266 | MMP14 substrate motif sequence | APLGLKAQ |
| 267 | MMP14 substrate motif sequence | DPLGLKAQ |
| 268 | MMP14 substrate motif sequence | GPHGLKAQ |
| 269 | MMP14 substrate motif sequence | GPSGLKAQ |
| 270 | MMP14 substrate motif sequence | GPQGLKAQ |
| 271 | MMP14 substrate motif sequence | GPPGLKAQ |

APPENDIX B-continued

Sequences

| SEQ ID NO. | Name | Sequence |
|---|---|---|
| 272 | MMP14 substrate motif sequence | GPEGLKAQ |
| 273 | MMP14 substrate motif sequence | GPFGLKAQ |
| 274 | MMP14 substrate motif sequence | GPRGLKAQ |
| 275 | MMP14 substrate motif sequence | GPGGLKAQ |
| 276 | MMP14 substrate motif sequence | GPAGLKAQ |
| 277 | MMP14 substrate motif sequence | LPAGLKGA |
| 195 | MMP14 substrate motif sequence | GPAGLYAQ |
| 278 | MMP14 substrate motif sequence | GPANLVAQ |
| 279 | MMP14 substrate motif sequence | GPAALVGA |
| 280 | MMP14 substrate motif sequence | GPANLRAQ |
| 281 | MMP14 substrate motif sequence | GPAGLRAQ |
| 282 | MMP14 substrate motif sequence | GPAGLVAQ |
| 283 | MMP14 substrate motif sequence | GPAGLRGA |
| 284 | MMP14 substrate motif sequence | LPAGLVGA |
| 285 | MMP14 substrate motif sequence | GPAGLKGA |

APPENDIX B-continued

Sequences

| SEQ ID NO. | Name | Sequence |
|---|---|---|
| 286 | MMP14 substrate motif sequence | GPLALKAQ |
| 287 | MMP14 substrate motif sequence | GPLNLKAQ |
| 288 | MMP14 substrate motif sequence | GPLHLKAQ |
| 289 | MMP14 substrate motif sequence | GPLYLKAQ |
| 290 | MMP14 substrate motif sequence | GPLPLKAQ |
| 291 | MMP14 substrate motif sequence | GPLELKAQ |
| 292 | MMP14 substrate motif sequence | GPLRLKAQ |
| 293 | MMP14 substrate motif sequence | GPLLLKAQ |
| 294 | MMP14 substrate motif sequence | GPLSLKAQ |
| 295 | MMP14 substrate motif sequence | GPLGLYAQ |
| 296 | MMP14 substrate motif sequence | GPLGLFAQ |
| 297 | MMP14 substrate motif sequence | GPLGLLAQ |
| 298 | MMP14 substrate motif sequence | GPLGLHAQ |
| 299 | MMP14 substrate motif sequence | GPLGLRAQ |
| 300 | MMP14 substrate motif sequence | GPLGLAAQ |

APPENDIX B-continued

Sequences

| SEQ ID NO. | Name | Sequence |
|---|---|---|
| 301 | MMP14 substrate motif sequence | GPLGLEAQ |
| 302 | MMP14 substrate motif sequence | GpLGLGAQ |
| 303 | MMP14 substrate motif sequence | GPLGLPAQ |
| 304 | MMP14 substrate motif sequence | GPLGLQAQ |
| 305 | MMP14 substrate motif sequence | GPLGLSAQ |
| 306 | MMP14 substrate motif sequence | GPLGLVAQ |
| 307 | MMP14 substrate motif sequence | GPLGLKLQ |
| 308 | MMP14 substrate motif sequence | GPLGLKFQ |
| 309 | MMP14 substrate motif sequence | GPLGLKEQ |
| 310 | MMP14 substrate motif sequence | GPLGLKKQ |
| 311 | MMP14 substrate motif sequence | GPLGLKQQ |
| 312 | MMP14 substrate motif sequence | GPLGLKSQ |
| 313 | MMP14 substrate motif sequence | GPLGLKGQ |
| 314 | MMP14 substrate motif sequence | GPLGLKHQ |
| 315 | MMP14 substrate motif sequence | GPLGLKPQ |

APPENDIX B-continued

Sequences

| SEQ ID NO. | Name | Sequence |
|---|---|---|
| 316 | MMP14 substrate motif sequence | GPLGLKAG |
| 317 | MMP14 substrate motif sequence | GPLGLKAF |
| 318 | MMP14 substrate motif sequence | GPLGLKAP |
| 319 | MMP14 substrate motif sequence | GPLGLKAL |
| 320 | MMP14 substrate motif sequence | GPLGLKAE |
| 321 | MMP14 substrate motif sequence | GPLGLKAA |
| 322 | MMP14 substrate motif sequence | GPLGLKAH |
| 323 | MMP14 substrate motif sequence | GPLGLKAK |
| 324 | MP14 substrate motif sequence | GPLGLKAS |
| 325 | MMP14 substrate motif sequence | GPLGLFGA |
| 326 | MMP14 substrate motif sequence | GPLGLQGA |
| 327 | MMP14 substrate motif sequence | GPLGLVGA |
| 328 | MMP14 substrate motif sequence | GPLGLAGA |
| 329 | MMP14 substrate motif sequence | GPLGLLGA |
| 330 | MMP14 substrate motif sequence | GPLGLRGA |

APPENDIX B-continued

Sequences

| SEQ ID NO. | Name | Sequence |
|---|---|---|
| 331 | MMP14 substrate motif sequence | GPLGLYGA |
| 332 | CTSL1 substrate motif sequence | ALFKSSPP |
| 333 | CTSL1 substrate motif sequence | SPFRSSRQ |
| 334 | CTSL1 substrate motif sequence | KLFKSSPP |
| 335 | CTSL1 substrate motif sequence | HLFKSSPP |
| 336 | CTSL1 substrate motif sequence | SLFKSSPP |
| 337 | CTSL1 substrate motif sequence | QLFKSSPP |
| 338 | CTSL1 substrate motif sequence | LLFKSSPP |
| 339 | CTSL1 substrate motif sequence | PLFKSSPP |
| 340 | CTSL1 substrate motif sequence | FLFKSSPP |
| 341 | CTSL1 substrate motif sequence | GLFKSSPP |
| 342 | CTSL1 substrate motif sequence | VLFKSSPP |
| 343 | CTSL1 substrate motif sequence | ELFKSSPP |
| 344 | CTSL1 substrate motif sequence | AKFKSSPP |
| 345 | CTSL1 substrate motif sequence | AHFKSSPP |

APPENDIX B-continued

Sequences

| SEQ ID NO. | Name | Sequence |
|---|---|---|
| 346 | CTSL1 substrate motif sequence | AGFKSSPP |
| 347 | CTSL1 substrate motif sequence | APFKSSPP |
| 348 | CTSL1 substrate motif sequence | ANFKSSPP |
| 349 | CTSL1 substrate motif sequence | AFFKSSPP |
| 350 | CTSL1 substrate motif sequence | AAFKSSPP |
| 351 | CTSL1 substrate motif sequence | ASFKSSPP |
| 352 | CTSL1 substrate motif sequence | AEFKSSPP |
| 353 | CTSL1 substrate motif sequence | ALRKSSPP |
| 354 | CTSL1 substrate motif sequence | ALLKSSPP |
| 355 | CTSL1 substrate motif sequence | ALAKSSPP |
| 356 | CTSL1 substrate motif sequence | ALQKSSPP |
| 357 | CTSL1 substrate motif sequence | ALHKSSPP |
| 358 | CTSL1 substrate motif sequence | ALPKSSPP |
| 359 | CTSL1 substrate motif sequence | ALTKSSPP |
| 360 | CTSL1 substrate motif sequence | ALGKSSPP |

APPENDIX B-continued

Sequences

| SEQ ID NO. | Name | Sequence |
|---|---|---|
| 361 | CTSL1 substrate motif sequence | ALDKSSPP |
| 199 | CTSL1 substrate motif sequence | ALFFSSPP |
| 362 | CTSL1 substrate motif sequence | ALFHSSPP |
| 363 | CTSL1 substrate motif sequence | ALFTSSPP |
| 364 | CTSL1 substrate motif sequence | ALFASSPP |
| 365 | CTSL1 substrate motif sequence | ALFQSSPP |
| 366 | CTSL1 substrate motif sequence | ALFLSSPP |
| 367 | CTSL1 substrate motif sequence | ALFGSSPP |
| 368 | CTSL1 substrate motif sequence | ALFESSPP |
| 369 | CTSL1 substrate motif sequence | ALFPSSPP |
| 370 | CTSL1 substrate motif sequence | ALFKHSPP |
| 371 | CTSL1 substrate motif sequence | ALFKLSPP |
| 372 | CTSL1 substrate motif sequence | ALFKKSPP |
| 373 | CTSL1 substrate motif sequence | ALFKASPP |
| 374 | CTSL1 substrate motif sequence | ALFKISPP |

APPENDIX B-continued

Sequences

| SEQ ID NO. | Name | Sequence |
|---|---|---|
| 375 | CTSL1 substrate motif sequence | ALFKGSPP |
| 376 | CTSL1 substrate motif sequence | ALFKNSPP |
| 377 | CTSL1 substrate motif sequence | ALFKRSPP |
| 378 | CTSL1 substrate motif sequence | ALFKESPP |
| 379 | CTSL1 substrate motif sequence | ALFKFSPP |
| 380 | CTSL1 substrate motif sequence | ALFKPSPP |
| 381 | CTSL1 substrate motif sequence | ALFKSFPP |
| 382 | CTSL1 substrate motif sequence | ALFKSLPP |
| 383 | CTSL1 substrate motif sequence | ALFKSIPP |
| 384 | CTSL1 substrate motif sequence | ALFKSKPP |
| 385 | CTSL1 substrate motif sequence | ALFKSAPP |
| 386 | CTSL1 substrate motif sequence | ALFKSQPP |
| 387 | CTSL1 substrate motif sequence | ALFKSPPP |
| 388 | CTSL1 substrate motif sequence | ALFKSEPP |
| 389 | CTSL1 substrate motif sequence | ALFKSGPP |

APPENDIX B-continued

Sequences

| SEQ ID NO. | Name | Sequence |
|---|---|---|
| 198 | CTSL1 substrate motif sequence | ALFKSSFP |
| 390 | CTSL1 substrate motif sequence | ALFKSSLP |
| 391 | CTSL1 substrate motif sequence | ALFKSSGP |
| 392 | CTSL1 substrate motif sequence | ALFKSSSP |
| 393 | CTSL1 substrate motif sequence | ALFKSSVP |
| 394 | CTSL1 substrate motif sequence | ALFKSSHP |
| 395 | CTSL1 substrate motif sequence | ALFKSSAP |
| 396 | CTSL1 substrate motif sequence | ALFKSSNP |
| 397 | CTSL1 substrate motif sequence | ALFKSSKP |
| 398 | CTSL1 substrate motif sequence | ALFKSSEP |
| 399 | CTSL1 substrate motif sequence | ALFKSSPF |
| 400 | CTSL1 substrate motif sequence | ALFKSSPH |
| 401 | CTSL1 substrate motif sequence | ALFKSSPG |
| 402 | CTSL1 substrate motif sequence | ALFKSSPA |
| 403 | CTSL1 substrate motif sequence | ALFKSSPS |

APPENDIX B-continued

Sequences

| SEQ ID NO. | Name | Sequence |
|---|---|---|
| 404 | CTSL1 substrate motif sequence | ALFKSSPV |
| 405 | CTSL1 substrate motif sequence | ALFKSSPQ |
| 406 | CTSL1 substrate motif sequence | ALFKSSPK |
| 407 | CTSL1 substrate motif sequence | ALFKSSPL |
| 408 | CTSL1 substrate motif sequence | ALFKSSPD |

SEQUENCE LISTING (408 sequences)

SEQ ID NO: 1 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 2 - protein, 609 aa, Homo sapiens [sequence omitted]

SEQ ID NO: 3 - protein, 8 aa, Unknown
  Description of Unknown: Protease cleavage site sequence
KRALGLPG

SEQ ID NO: 4 - protein, 40 aa, Unknown
  Description of Unknown: Protease cleavage site sequence
DEDEDEDEDEDEDEDERPLALWRSDRDRDRDRDRDRDRDR

SEQ ID NO: 5 - protein, 5 aa, Unknown
  Description of Unknown: Protease cleavage site sequence
  MOD_RES (3)..(3): Ser or Thr
  MOD_RES (4)..(4): Leu or Ile
  MOD_RES (5)..(5): Ser or Thr
PRXXX

SEQ ID NO: 6 - protein, 5 aa, Unknown
  Description of Unknown: Protease cleavage site sequence
LEATA

SEQ ID NO: 7 - protein, 10 aa, Unknown
  Description of Unknown: Protease cleavage site sequence
GGAANLVRGG

SEQ ID NO: 8 - protein, 10 aa, Unknown
  Description of Unknown: Protease cleavage site sequence
SGRIGFLRTA

SEQ ID NO: 9 - protein, 6 aa, Unknown
  Description of Unknown: Protease cleavage site sequence
PLGLAG

SEQ ID NO: 10 - protein, 6 aa, Unknown
  Description of Unknown: Protease cleavage site sequence
  MOD_RES (6)..(6): Any amino acid
PLGLAX

SEQ ID NO: 11 - protein, 6 aa, Unknown
  Description of Unknown: Protease cleavage site sequence
  MOD_RES (4)..(4): Cys(me)
PLGCAG

SEQ ID NO: 12 - protein, 8 aa, Unknown
  Description of Unknown: Protease cleavage site sequence
ESPAYYTA

SEQ ID NO: 13 - protein, 6 aa, Unknown
  Description of Unknown: Protease cleavage site sequence
RLQLKL

SEQ ID NO: 14 - protein, 7 aa, Unknown
  Description of Unknown: Protease cleavage site sequence
RLQLKAC

SEQ ID NO: 15 - protein, 7 aa, Unknown
  Description of Unknown: Protease cleavage site sequence
  MOD_RES (3)..(3): Cit
  MOD_RES (5)..(5): Hof
EPXGXYL

SEQ ID NO: 16 - protein, 5 aa, Unknown
  Description of Unknown: Protease cleavage site sequence
SGRSA

SEQ ID NO: 17 - protein, 4 aa, Unknown
  Description of Unknown: Protease cleavage site sequence
DAFK

SEQ ID NO: 18 - protein, 5 aa, Unknown
  Description of Unknown: Protease cleavage site sequence
GGGRR

SEQ ID NO: 19 - protein, 4 aa, Unknown
  Description of Unknown: Protease cleavage site sequence
GFLG

SEQ ID NO: 20 - protein, 4 aa, Unknown
  Description of Unknown: Protease cleavage site sequence
ALAL

SEQ ID NO: 21 - protein, 2 aa, Unknown
  Description of Unknown: Protease cleavage site sequence
FK

SEQ ID NO: 22 - protein, 3 aa, Unknown
  Description of Unknown: Protease cleavage site sequence
NLL

SEQ ID NO: 23 - protein, 5 aa, Unknown
  Description of Unknown: Protease cleavage site sequence
  MOD_RES (3)..(3): Cys(Et)
PICFF

SEQ ID NO: 24 - protein, 8 aa, Unknown
  Description of Unknown: Protease cleavage site sequence
GGPRGLPG

SEQ ID NO: 25 - protein, 6 aa, Unknown
  Description of Unknown: Protease cleavage site sequence
HSSKLQ

SEQ ID NO: 26 - protein, 7 aa, Unknown
  Description of Unknown: Protease cleavage site sequence
HSSKLQL

SEQ ID NO: 27 - protein, 9 aa, Unknown
  Description of Unknown: Protease cleavage site sequence
HSSKLQEDA

SEQ ID NO: 28 - protein, 10 aa, Unknown
  Description of Unknown: Protease cleavage site sequence
LVLASSSFGY

SEQ ID NO: 29 - protein, 10 aa, Unknown
  Description of Unknown: Protease cleavage site sequence
GVSQNYPIVG

SEQ ID NO: 30 - protein, 10 aa, Unknown
  Description of Unknown: Protease cleavage site sequence
GVVQASCRLA

SEQ ID NO: 31 - protein, 4 aa, Unknown
  Description of Unknown: Protease cleavage site sequence
  MOD_RES (2)..(2): Pip
FXRS

SEQ ID NO: 32 - protein, 6 aa, Unknown
  Description of Unknown: Protease cleavage site sequence
DPRSFL

SEQ ID NO: 33 - protein, 6 aa, Unknown
  Description of Unknown: Protease cleavage site sequence
PPRSFL

SEQ ID NO: 34 - protein, 4 aa, Unknown
  Description of Unknown: Protease cleavage site sequence
DEVD

SEQ ID NO: 35 - protein, 5 aa, Unknown
  Description of Unknown: Protease cleavage site sequence
DEVDP

SEQ ID NO: 36 - protein, 8 aa, Unknown
  Description of Unknown: Protease cleavage site sequence
KGSGDVEG

SEQ ID NO: 37 - protein, 6 aa, Unknown
  Description of Unknown: Protease cleavage site sequence
GWEHDG

SEQ ID NO: 38 - protein, 7 aa, Unknown
  Description of Unknown: Protease cleavage site sequence
EDDDDKA

SEQ ID NO: 39 - protein, 9 aa, Unknown
  Description of Unknown: Protease cleavage site sequence
KQEQNPGST

SEQ ID NO: 40 - protein, 6 aa, Unknown
  Description of Unknown: Protease cleavage site sequence
GKAFRR

SEQ ID NO: 41 - protein, 4 aa, Unknown
  Description of Unknown: Protease cleavage site sequence
DAFK

SEQ ID NO: 42 - protein, 4 aa, Unknown
  Description of Unknown: Protease cleavage site sequence
DVLK

SEQ ID NO: 43 - protein, 4 aa, Unknown
  Description of Unknown: Protease cleavage site sequence
DAFK

SEQ ID NO: 44 - protein, 7 aa, Unknown
  Description of Unknown: Protease cleavage site sequence
ALLLALL

SEQ ID NO: 45 - protein, 652 aa, Artificial Sequence
  Description of Artificial Sequence: Synthetic polypeptide
QVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 46 - protein, 652 aa, Artificial Sequence
  Description of Artificial Sequence: Synthetic polypeptide
QVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 47 - protein, 553 aa, Artificial Sequence
  Description of Artificial Sequence: Synthetic polypeptide
EVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSGGGGSGGGGSGGGGSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 48 - protein, 553 aa, Artificial Sequence
  Description of Artificial Sequence: Synthetic polypeptide
EVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 49 - protein, 553 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 50 - protein, 682 aa, Artificial Sequence
  Description of Artificial Sequence: Synthetic polypeptide
QVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 51 - protein, 667 aa, Artificial Sequence
  Description of Artificial Sequence: Synthetic polypeptide
QVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSSGGPGPAGMKGLPGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 52 - protein, 682 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHH

SEQ ID NO: 53 - protein, 393 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 54 - protein, 423 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 55 - protein, 682 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHH

SEQ ID NO: 56 - protein, 682 aa, Artificial Sequence
  Description of Artificial Sequence: Synthetic polypeptide
QVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSGGGGSGGGGSGGGGSSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 57 - protein, 393 aa, Artificial Sequence
  Description of Artificial Sequence: Synthetic polypeptide
EVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 58 - protein, 423 aa, Artificial Sequence
  Description of Artificial Sequence: Synthetic polypeptide
EVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSGGGGSGGGGSGGGGSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 59 - protein, 669 aa, Artificial Sequence
  Description of Artificial Sequence: Synthetic polypeptide
QVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSQVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARWRGDGYYAYFDVWGAGTTVTVSSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKHHHHHHEPEA

SEQ ID NO: 60 - protein, 669 aa, Artificial Sequence
  Description of Artificial Sequence: Synthetic polypeptide
QVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKGGGGSGGGGSGGGGSQVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARWRGDGYYAYFDVWGAGTTVTVSSHHHHHHEPEA

SEQ ID NO: 61 - protein, 689 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSQVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARWRGDGYYAYFDVWGAGTTVTVSSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHHEPEA

SEQ ID NO: 62 - protein, 689 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKGGGGSGGGGSGGGGSQVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARWRGDGYYAYFDVWGAGTTVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHHEPEA

SEQ ID NO: 63 - protein, 272 aa, Unknown
  Description of Unknown: IL2Ra sequence
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 64 - protein, 551 aa, Unknown
  Description of Unknown: IL2Rb sequence
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 65 - protein, 369 aa, Unknown
  Description of Unknown: IL2Rg sequence
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 66 - protein, 520 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAHHHHHH

SEQ ID NO: 67 - protein, 524 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASHHHHHH

SEQ ID NO: 68 - protein, 940 aa, Artificial Sequence
  Description of Artificial Sequence: Synthetic polypeptide
QSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSGGGGSGGGGSGGGGSGGGGSGGGGSGGGGSSGGPGPAGMKGLPGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 69 - protein, 1069 aa, Artificial Sequence
  Description of Artificial Sequence: Synthetic polypeptide
QSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSGGGGSGGGGSGGGGSGGGGSGGGGSGGGGSSGGPGPAGMKGLPGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHHEPEA

SEQ ID NO: 70 - protein, 1069 aa, Artificial Sequence
  Description of Artificial Sequence: Synthetic polypeptide
QVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSGGGGSGGGGSGGGGSQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSGGGGSGGGGSGGGGSGGGGSGGGGSGGGGSSGGPGPAGMKGLPGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 71 - protein, 940 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSGGGGSGGGGSGGGGSGGGGSGGGGSGGGGSSGGPGPAGMKGLPGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAHHHHHHEPEA

SEQ ID NO: 72 - protein, 940 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSGGGGSGGGGSGGGGSGGGGSGGGGSGGGGSQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSHHHHHHEPEA

SEQ ID NO: 73 - protein, 940 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSGGGGSGGGGSGGGGSGGGGSGGGGSGGGGSQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 74 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 75 - protein, 215 aa, Mus musculus
MCQSRYLLFLATLALLNHLSLARVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSA

SEQ ID NO: 76 - protein, 862 aa, Unknown
  Description of Unknown: IL12Rb-2 sequence
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 77 - protein, 662 aa, Unknown
  Description of Unknown: IL12Rb-1 sequence
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 78 - skipped

SEQ ID NO: 79 - protein, 328 aa, Homo sapiens; identical to SEQ ID NO: 74

SEQ ID NO: 80 - protein, 335 aa, Mus musculus
MCPQKLTISWFAIVLLVSPLMAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 81 - protein, 399 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 82 - protein, 547 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 83 - protein, 547 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCGGGGSGGGGSGGGGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 84 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 85 - protein, 155 aa, Mus musculus
MNATHCILALQLFLMAVSGCYCHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRC

SEQ ID NO: 86 - protein, 699 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 87 - protein, 436 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 88 - protein, 428 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 89 - protein, 489 aa, Unknown
  Description of Unknown: IFN-gamma-R1 sequence
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 90 - protein, 337 aa, Unknown
  Description of Unknown: IFN-gamma-R2 sequence
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 91 - protein, 528 aa, Artificial Sequence
  Description of Artificial Sequence: Synthetic polypeptide
QVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 92 - protein, 658 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHH

SEQ ID NO: 93 - protein, 1337 aa, Artificial Sequence
  Description of Artificial Sequence: Synthetic polypeptide
EAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHH

SEQ ID NO: 94 - protein, 1485 aa, Artificial Sequence
  Description of Artificial Sequence: Synthetic polypeptide
EAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCGGGGSGGGGSGGGGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHH

SEQ ID NO: 95 - protein, 698 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCGGGGSGGGGSGGGGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 96 - protein, 699 aa, Artificial Sequence; identical to SEQ ID NO: 86
  Description of Artificial Sequence: Synthetic polypeptide

SEQ ID NO: 97 - protein, 554 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 98 - protein, 554 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHHEPEA

SEQ ID NO: 99 - protein, 702 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHHEPEA

SEQ ID NO: 100 - protein, 702 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 101 - protein, 702 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHHEPEA

SEQ ID NO: 102 - protein, 832 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARGVGAFRPYRKHEWGQGTLVTVSRGGGGSGGGGSGGGGSSSELTQDPAVSVALGQTVRITCQGDSLRSYYASWYQQKPGQAPVLVIYGKNNRPSGIPDRFSGSSSGNTASLTTTGAQAEDEADYYCNSSPFEHNLVVFGGGTKLTVLHHHHHHEPEA

SEQ ID NO: 103 - protein, 276 aa, Artificial Sequence
  Description of Artificial Sequence: Synthetic polypeptide
MDMRVPAQLLGLLLLWLRGARCEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARGVGAFRPYRKHEWGQGTLVTVSRGGGGSGGGGSGGGGSSSELTQDPAVSVALGQTVRITCQGDSLRSYYASWYQQKPGQAPVLVIYGKNNRPSGIPDRFSGSSSGNTASLTTTGAQAEDEADYYCNSSPFEHNLVVFGGGTKLTVLHHHHHHEPEA

SEQ ID NO: 104 - protein, 573 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCHHHHHHEPEA

SEQ ID NO: 105 - protein, 573 aa, Artificial Sequence
  Description of Artificial Sequence: Synthetic polypeptide
MDMRVPAQLLGLLLLWLRGARCHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 106 - protein, 1511 aa, Artificial Sequence
  Description of Artificial Sequence: Synthetic polypeptide
MDMRVPAQLLGLLLLWLRGARCHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHHEPEA

SEQ ID NO: 107 - protein, 1511 aa, Artificial Sequence
  Description of Artificial Sequence: Synthetic polypeptide
MDMRVPAQLLGLLLLWLRGARCEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCHHHHHHEPEA

SEQ ID NO: 108 - protein, 2110 aa, Artificial Sequence
  Description of Artificial Sequence: Synthetic polypeptide
MDMRVPAQLLGLLLLWLRGARCEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHHEPEA

SEQ ID NO: 109 - protein, 2120 aa, Artificial Sequence
  Description of Artificial Sequence: Synthetic polypeptide
MDMRVPAQLLGLLLLWLRGARCEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSGGGGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAGGGGSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHHEPEA

SEQ ID NO: 110 - protein, 2130 aa, Artificial Sequence
  Description of Artificial Sequence: Synthetic polypeptide
MDMRVPAQLLGLLLLWLRGARCEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSGGGGSGGGGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAGGGGSGGGGSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHHEPEA

SEQ ID NO: 111 - protein, 703 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 112 - protein, 832 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHHEPEA

SEQ ID NO: 113 - protein, 832 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSHGTVIESLESLNNYFNSSGIDVEEKSLFLDIWRNWQKDGDMKILQSQIISFYLRLFEVLKDNQAISNNISVIESHLITTFFSNSKAKKDAFMSIAKFEVNNPQVQRQAFNELIRVVHQLLPESSLRKRKRSRCSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 114 - protein, 549 aa, Artificial Sequence
  Description of Artificial Sequence: Synthetic polypeptide
MDMRVPAQLLGLLLLWLRGARCRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSHHHHHH

SEQ ID NO: 115 - protein, 579 aa, Artificial Sequence
  Description of Artificial Sequence: Synthetic polypeptide
MDMRVPAQLLGLLLLWLRGARCRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSSGGPGPAGMKGLPGSGGGGSGGGGSGGGGSMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSHHHHHH

SEQ ID NO: 116 - protein, 809 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 117 - protein, 938 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 118 - protein, 938 aa, Artificial Sequence; identical to SEQ ID NO: 117
  Description of Artificial Sequence: Synthetic polypeptide

SEQ ID NO: 119 - protein, 938 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHH

SEQ ID NO: 120 - protein, 962 aa, Artificial Sequence
  Description of Artificial Sequence: Synthetic polypeptide
MDMRVPAQLLGLLLLWLRGARCIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSAGGGGSGGGGSGGGGSGGGGSGGGGSGGGGSGGGGSGGGGSGGGGSQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 121 - protein, 832 aa, Artificial Sequence
  Description of Artificial Sequence: Synthetic polypeptide
MDMRVPAQLLGLLLLWLRGARCIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSGGGGSGGGGSGGGGSGGGGSGGGGSGGGGSQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSHHHHHHEPEA

SEQ ID NO: 122 - protein, 1091 aa, Artificial Sequence
  Description of Artificial Sequence: Synthetic polypeptide
MDMRVPAQLLGLLLLWLRGARCIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSGGGGSGGGGSGGGGSGGGGSGGGGSGGGGSQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHHEPEA

SEQ ID NO: 123 - protein, 1091 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSGGGGSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSGGGGSGGGGSGGGGSGGGGSGGGGSGGGGSQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 124 - protein, 1091 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSSGGPGPAGMKGLPGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGPGPAGMKGLPGSGGGGSGGGGSGGGGSGGGGSGGGGSGGGGSQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 125 - protein, 674 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHH

SEQ ID NO: 126 - protein, 674 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 127 - protein, 425 aa, Artificial Sequence
  Description of Artificial Sequence: Synthetic polypeptide
MDMRVPAQLLGLLLLWLRGARCELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQGGGGSGGGGSGGGGSGGGGSGGGGSGGGGSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 128 - protein, 425 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQHHHHHH

SEQ ID NO: 129 - protein, 555 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQGGGGSGGGGSGGGGSGGGGSGGGGSGGGGSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 130 - protein, 555 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 131 - protein, 555 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 132 - protein, 575 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSGGGGSGGGGSGGGGSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 133 - protein, 704 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSSGGPGPAGMKGLPGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHH

SEQ ID NO: 134 - protein, 689 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 135 - protein, 545 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 136 - protein, 575 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 137 - protein, 421 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 138 - protein, 806 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGSGSGSGSGSGSGSGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGSGSGSGSGSGSGSGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGSGSGSGSGSGSGSGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 139 - protein, 676 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGSGSGSGSGSGSGSGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGSGSGSGSGSGSGSGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 140 - protein, 421 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGSGSGSGSGSGSGSGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 141 - protein, 420 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 142 - protein, 550 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 143 - protein, 420 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 144 - protein, 290 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 145 - protein, 291 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 146 - protein, 689 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 147 - protein, 704 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHH

SEQ ID NO: 148 - protein, 674 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 149 - protein, 704 aa, Artificial Sequence
  Description of Artificial Sequence: Synthetic polypeptide
MDMRVPAQLLGLLLLWLRGARCEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSGGGGSGGGGSGGGGSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHH

SEQ ID NO: 150 - protein, 704 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSGGGGSGGGGSGGGGSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 151 - protein, 689 aa, Artificial Sequence
  Description of Artificial Sequence: Synthetic polypeptide
MDMRVPAQLLGLLLLWLRGARCEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHH

SEQ ID NO: 152 - protein, 700 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSRGETGPAAPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 153 - protein, 276 aa, Artificial Sequence; identical to SEQ ID NO: 103
  Description of Artificial Sequence: Synthetic polypeptide

SEQ ID NO: 154 - protein, 279 aa, Artificial Sequence
  Description of Artificial Sequence: Synthetic polypeptide
MDMRVPAQLLGLLLLWLRGARCQVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARWRGDGYYAYFDVWGAGTTVTVSSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKHHHHHHEPEA

SEQ ID NO: 155 - protein, 279 aa, Artificial Sequence
  Description of Artificial Sequence: Synthetic polypeptide
MDMRVPAQLLGLLLLWLRGARCQVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARWRGDGYYAYFDVWGAGTTVTVSSSGGPGPAGMKGLPGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKHHHHHHEPEA

SEQ ID NO: 156 - protein, 279 aa, Artificial Sequence
  Description of Artificial Sequence: Synthetic polypeptide
MDMRVPAQLLGLLLLWLRGARCDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKGGGGSGGGGSGGGGSQVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARWRGDGYYAYFDVWGAGTTVTVSSHHHHHHEPEA

SEQ ID NO: 157 - protein, 279 aa, Artificial Sequence
  Description of Artificial Sequence: Synthetic polypeptide
MDMRVPAQLLGLLLLWLRGARCDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKSGGPGPAGMKGLPGSQVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARWRGDGYYAYFDVWGAGTTVTVSSHHHHHHEPEA

SEQ ID NO: 158 - protein, 295 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 159 - protein, 765 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHHEPEA

SEQ ID NO: 160 - protein, 765 aa, Artificial Sequence; identical to SEQ ID NO: 159
  Description of Artificial Sequence: Synthetic polypeptide

SEQ ID NO: 161 - protein, 765 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHHEPEA

SEQ ID NO: 162 - protein, 708 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHHEPEA

SEQ ID NO: 163 - protein, 708 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHHEPEA

SEQ ID NO: 164 - protein, 708 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHHEPEA

SEQ ID NO: 165 - protein, 161 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTHHHHHH

SEQ ID NO: 166 - protein, 708 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKGGGGSGGGGSGGGGSQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSHHHHHHEPEA

SEQ ID NO: 167 - protein, 708 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHHEPEA

SEQ ID NO: 168 - protein, 708 aa, Artificial Sequence
  Description of Artificial Sequence: Synthetic polypeptide
MDMRVPAQLLGLLLLWLRGARCQVQLQESGGGLVQAGGSLRLSCAASGRIFSIDIMSWYRQAPGKQRELVARITRGGTISYDDSVKGRFTISRDNAKNTVYLQMNSLKPEDTGVYYCNALYGTDYWGKGTQVTVSSSGGPGPAGMKGLPGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPGPAGMKGLPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHHEPEA

SEQ ID NO: 169 - protein, 450 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 170 - protein, 198 aa, Artificial Sequence
  Description of Artificial Sequence: Synthetic polypeptide
MDMRVPAQLLGLLLLWLRGARCCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKHHHHHHEPEA

SEQ ID NO: 171 - protein, 328 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKHHHHHHEPEA

SEQ ID NO: 172 - protein, 328 aa, Artificial Sequence
  Description of Artificial Sequence: Synthetic polypeptide
MDMRVPAQLLGLLLLWLRGARCCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 173 - protein, 1396 aa, Artificial Sequence
  Description of Artificial Sequence: Synthetic polypeptide
MDMRVPAQLLGLLLLWLRGARCEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHHEPEA

SEQ ID NO: 174 - protein, 797 aa, Artificial Sequence
  Description of Artificial Sequence: Synthetic polypeptide
MDMRVPAQLLGLLLLWLRGARCEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALASGGPGPAGMKGLPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKHHHHHHEPEA

SEQ ID NO: 175 - protein, 797 aa, Artificial Sequence
  Description of Artificial Sequence: Synthetic polypeptide
MDMRVPAQLLGLLLLWLRGARCCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKSGGPGPAGMKGLPGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHHEPEA

SEQ ID NO: 176 - protein, 587 aa, Artificial Sequence
  Description of Artificial Sequence: Synthetic polypeptide
MDMRVPAQLLGLLLLWLRGARCQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 177 - protein, 587 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGMKGLPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSQVQLQESGGGLAQAGGSLSLSCAASGFTVSNSVMAWYRQTPGKQREFVAIINSVGSTNYADSVKGRFTISRDNAKNTVYLQMNNLKPEDTAVYVCNRNFDRIYWGQGTQVTVSSHHHHHHEPEA

SEQ ID NO: 178 - protein, 458 aa, Artificial Sequence
  Description of Artificial Sequence: Synthetic polypeptide
MDMRVPAQLLGLLLLWLRGARCEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKGGGGSGGGGSGGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHHEPEA

SEQ ID NO: 179 - protein, 579 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPGPAGLYAQPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPGPAGLYAQPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHHEPEA

SEQ ID NO: 180 - protein, 579 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPPGGPAGIGPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPPGGPAGIGPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHHEPEA

SEQ ID NO: 181 - protein, 579 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPALFKSSFPPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPALFKSSFPPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHHEPEA

SEQ ID NO: 182 - protein, 581 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPPLAQKLKSSPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPPLAQKLKSSPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHHEPEA

SEQ ID NO: 183 - protein, 613 aa, Artificial Sequence
  Description of Artificial Sequence: Synthetic polypeptide
MDMRVPAQLLGLLLLWLRGARCAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTSGGPPGGPAGIGALFKSSFPPLAQKLKSSPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGGSGGGGSGGGGSGGGGSGGGGSSGGPPGGPAGIGALFKSSFPPLAQKLKSSPGSEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHHEPEA

SEQ ID NO: 184-191 - skipped (8 entries)

SEQ ID NO: 192 - protein, 267 aa, Artificial Sequence
  Description of Artificial Sequence: Synthetic polypeptide
MDMRVPAQLLGLLLLWLRGARCEVQLVESGGGLVQPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTTVTVSSGGGGSGGGGSGGGGSDIQMTQSPSSLSASVGDRVTITCKASQNVGTNVGWYQQKPGKAPKALIYSASFRYSGVPSRFSGSGSGTDFTLTISSLQPEDFATYYCQQYYTYPYTFGGGTKVEIKHHHHHH

SEQ ID NO: 193 - protein, 269 aa, Artificial Sequence
  Description of Artificial Sequence: Synthetic polypeptide
MDMRVPAQLLGLLLLWLRGARCQSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGGGGSGGGGSGGGGSQVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSHHHHHH

SEQ ID NO: 194 - protein, 124 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSS

SEQ ID NO: 195 - protein, 8 aa, Artificial Sequence
  Description of Artificial Sequence: Synthetic peptide
GPAGLYAQ

SEQ ID NO: 196 - protein, 8 aa, Artificial Sequence
  Description of Artificial Sequence: Synthetic peptide
GPAGMKGL

SEQ ID NO: 197 - protein, 8 aa, Artificial Sequence
  Description of Artificial Sequence: Synthetic peptide
PGGPAGIG

SEQ ID NO: 198 - protein, 8 aa, Artificial Sequence
  Description of Artificial Sequence: Synthetic peptide
ALFKSSFP

SEQ ID NO: 199 - protein, 8 aa, Artificial Sequence
  Description of Artificial Sequence: Synthetic peptide
ALFFSSPP

SEQ ID NO: 200 - protein, 8 aa, Artificial Sequence
  Description of Artificial Sequence: Synthetic peptide
LAQRLRSS

SEQ ID NO: 201 - protein, 8 aa, Artificial Sequence
  Description of Artificial Sequence: Synthetic peptide
LAQKLKSS

SEQ ID NO: 202 - protein, 30 aa, Artificial Sequence
  Description of Artificial Sequence: Synthetic polypeptide
GALFKSSFPSGGGPAGLYAQGGSGKGGSGK

SEQ ID NO: 203 - protein, 30 aa, Artificial Sequence
  Description of Artificial Sequence: Synthetic polypeptide
RGSGGGPAGLYAQGSGGGPAGLYAQGGSGK

SEQ ID NO: 204 - protein, 30 aa, Artificial Sequence
  Description of Artificial Sequence: Synthetic polypeptide
KGGGPAGLYAQGPAGLYAQGPAGLYAQGSR

SEQ ID NO: 205 - protein, 30 aa, Artificial Sequence
  Description of Artificial Sequence: Synthetic polypeptide
RGGPAGLYAQGGPAGLYAQGGGPAGLYAQK

SEQ ID NO: 206 - protein, 30 aa, Artificial Sequence
  Description of Artificial Sequence: Synthetic polypeptide
KGGALFKSSFPGGPAGIGPLAQKLKSSGGS

SEQ ID NO: 207 - protein, 30 aa, Artificial Sequence
  Description of Artificial Sequence: Synthetic polypeptide
SGGPGGPAGIGALFKSSFPLAQKLKSSGGG

SEQ ID NO: 208 - protein, 30 aa, Artificial Sequence
  Description of Artificial Sequence: Synthetic polypeptide
RGPLAQKLKSSALFKSSFPGGPAGIGGGGK

SEQ ID NO: 209 - protein, 30 aa, Artificial Sequence
  Description of Artificial Sequence: Synthetic polypeptide
GGGALFKSSFPLAQKLKSSPGGPAGIGGGR

SEQ ID NO: 210 - protein, 30 aa, Artificial Sequence
  Description of Artificial Sequence: Synthetic polypeptide
RGPGGPAGIGPLAQKLKSSALFKSSFPGGG

SEQ ID NO: 211 - protein, 30 aa, Artificial Sequence
  Description of Artificial Sequence: Synthetic polypeptide
RGGPLAQKLKSSPGGPAGIGALFKSSFPGK

SEQ ID NO: 212 - protein, 30 aa, Artificial Sequence
  Description of Artificial Sequence: Synthetic polypeptide
RSGGPAGLYAQALFKSSFPLAQKLKSSGGG

SEQ ID NO: 213 - protein, 30 aa, Artificial Sequence
  Description of Artificial Sequence: Synthetic polypeptide
GGPLAQKLKSSALFKSSFPGPAGLYAQGGR

SEQ ID NO: 214 - protein, 30 aa, Artificial Sequence
  Description of Artificial Sequence: Synthetic polypeptide
GGALFKSSFPGPAGLYAQPLAQKLKSSGGK

SEQ ID NO: 215 - protein, 30 aa, Artificial Sequence
  Description of Artificial Sequence: Synthetic polypeptide
RGGALFKSSFPLAQKLKSSGPAGLYAQGGK

SEQ ID NO: 216 - protein, 30 aa, Artificial Sequence
  Description of Artificial Sequence: Synthetic polypeptide
RGGGPAGLYAQPLAQKLKSSALFKSSFPGG

SEQ ID NO: 217 - protein, 30 aa, Artificial Sequence
  Description of Artificial Sequence: Synthetic polypeptide
SGPLAQKLKSSGPAGLYAQALFKSSFPGSK

SEQ ID NO: 218 - protein, 30 aa, Artificial Sequence
  Description of Artificial Sequence: Synthetic polypeptide
KGGPGGPAGIGPLAQRLRSSALFKSSFPGR

SEQ ID NO: 219 - protein, 30 aa, Artificial Sequence
  Description of Artificial Sequence: Synthetic polypeptide
KSGPGGPAGIGALFFSSPPLAQKLKSSGGR

SEQ ID NO: 220 - protein, 30 aa, Artificial Sequence
  Description of Artificial Sequence: Synthetic polypeptide
SGGFPRSGGSFNPRTFGSKRKRRGSRGGGG

SEQ ID NO: 221 - protein, 7 aa, Artificial Sequence
  Description of Artificial Sequence: Synthetic peptide
GPLGVRG

SEQ ID NO: 222 - protein, 8 aa, Artificial Sequence
  Description of Artificial Sequence: Synthetic peptide
IPVSLRSG

SEQ ID NO: 223 - protein, 8 aa, Artificial Sequence
  Description of Artificial Sequence: Synthetic peptide
VPLSLYSG

SEQ ID NO: 224 - protein, 10 aa, Artificial Sequence
  Description of Artificial Sequence: Synthetic peptide
SGESPAYYTA

SEQ ID NO: 225 - protein, 426 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGLYAQPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKSGGPGPAGLYAQPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 226 - protein, 426 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPALFKSSFPPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKSGGPALFKSSFPPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 227 - protein, 428 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPPLAQKLKSSPGSCDLPQTHNLRNKRALTLLVQMRRLSPLSCLKDRKDFGFPQEKVDAQQIKKAQAIPVLSELTQQILNIFTSKDSSAAWNTTLLDSFCNDLHQQLNDLQGCLMQQVGVQEFPLTQEDALLAVRKYFHRITVYLREKKHSPCAWEVVRAEVWRALSSSANVLGRLREEKSGGPPLAQKLKSSPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 228 - protein, 425 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPGPAGLYAQPGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGGPGPAGLYAQPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 229 - protein, 425 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPALFKSSFPPGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGGPALFKSSFPPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 230 - protein, 427 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSSGGPPLAQKLKSSPGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGGPPLAQKLKSSPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 231 - protein, 5 aa, Artificial Sequence
  Description of Artificial Sequence: Synthetic peptide
GGGGS

SEQ ID NO: 232 - protein, 5 aa, Artificial Sequence
  Description of Artificial Sequence: Synthetic peptide
GGGGS

SEQ ID NO: 233 - protein, 6 aa, Artificial Sequence
  Description of Artificial Sequence: Synthetic peptide
GSGSGS

SEQ ID NO: 234 - protein, 13 aa, Artificial Sequence
  Description of Artificial Sequence: Synthetic peptide
GSGGGSGGGSGGT

SEQ ID NO: 235 - protein, 8 aa, Artificial Sequence
  Description of Artificial Sequence: Synthetic peptide
LAQKSKSS

SEQ ID NO: 236 - protein, 9 aa, Artificial Sequence
  Description of Artificial Sequence: Synthetic peptide
ALFFSSPPS

SEQ ID NO: 237 - protein, 5 aa, Unknown
  Description of Unknown: Sortase A recognition sequence
  MOD_RES (3)..(3): Any amino acid
LPXTG

SEQ ID NO: 238 - protein, 25 aa, Artificial Sequence
  Description of Artificial Sequence: Synthetic peptide
  MISC_FEATURE (1)..(25): This sequence may encompass 1-5 "Gly Gly Gly Gly Ser" repeating units
GGGGSGGGGSGGGGSGGGGSGGGGS

SEQ ID NO: 239 - protein, 20 aa, Artificial Sequence
  Description of Artificial Sequence: Synthetic peptide
  MISC_FEATURE (1)..(20): This sequence may encompass 1-5 "Gly Gly Gly Ser" repeating units
GGGSGGGSGGGSGGGSGGGS

SEQ ID NO: 240 - protein, 7 aa, Unknown
  Description of Unknown: Protease cathepsin S cleavage site sequence
GAVVRGA

SEQ ID NO: 241 - protein, 5 aa, Artificial Sequence
  Description of Artificial Sequence: Synthetic peptide
GGGGS

SEQ ID NO: 242 - protein, 15 aa, Artificial Sequence
  Description of Artificial Sequence: Synthetic peptide
GGGGSGGGGSGGGGS

SEQ ID NO: 243 - protein, 6 aa, Artificial Sequence
  Description of Artificial Sequence: Synthetic 6xHis tag
HHHHHH

SEQ ID NO: 244 - protein, 12 aa, Artificial Sequence
  Description of Artificial Sequence: Synthetic peptide
  MOD_RES (7)..(7): N-3-(2,4-dinitrophenyl)-L-2,3-diaminopropionyl
PLAQAVXRSSSR

SEQ ID NO: 245 - protein, 9 aa, Artificial Sequence
  Description of Artificial Sequence: Synthetic peptide
ALFFSSPPK

SEQ ID NO: 246 - protein, 10 aa, Artificial Sequence
  Description of Artificial Sequence: Synthetic peptide
ALFFSSPPSK

SEQ ID NO: 247 - protein, 11 aa, Artificial Sequence
  Description of Artificial Sequence: Synthetic peptide
PGGPAGIGALF

SEQ ID NO: 248 - protein, 8 aa, Artificial Sequence
  Description of Artificial Sequence: Synthetic peptide
FNPRTFGS

SEQ ID NO: 249 - protein, 8 aa, Artificial Sequence
  Description of Artificial Sequence: Synthetic peptide
RKRRGSRG

SEQ ID NO: 250 - protein, 7 aa, Artificial Sequence
  Description of Artificial Sequence: Synthetic peptide
KLKSSGP

SEQ ID NO: 251 - protein, 8 aa, Artificial Sequence
  Description of Artificial Sequence: Synthetic peptide
KLKSSALF

SEQ ID NO: 252 - protein, 8 aa, Artificial Sequence
  Description of Artificial Sequence: Synthetic peptide
RLRSSALF

SEQ ID NO: 253 - protein, 7 aa, Artificial Sequence
  Description of Artificial Sequence: Synthetic peptide
LAQRLSS

SEQ ID NO: 254 - protein, 4 aa, Artificial Sequence
  Description of Artificial Sequence: Synthetic peptide
RKRR

SEQ ID NO: 255 - protein, 4 aa, Artificial Sequence
  Description of Artificial Sequence: Synthetic peptide
FNPR

SEQ ID NO: 256 - protein, 4 aa, Artificial Sequence
  Description of Artificial Sequence: Synthetic peptide
QKLK

SEQ ID NO: 257 - protein, 4 aa, Artificial Sequence
  Description of Artificial Sequence: Synthetic peptide
ALFK

SEQ ID NO: 258 - protein, 8 aa, Artificial Sequence
  Description of Artificial Sequence: Synthetic peptide
GPLGLKAQ

SEQ ID NO: 259 - protein, 8 aa, Artificial Sequence
  Description of Artificial Sequence: Synthetic peptide
LPLGLKAQ

SEQ ID NO: 260 - protein, 8 aa, Artificial Sequence
  Description of Artificial Sequence: Synthetic peptide
SPLGLKAQ

SEQ ID NO: 261 - protein, 8 aa, Artificial Sequence
  Description of Artificial Sequence: Synthetic peptide
QPLGLKAQ

SEQ ID NO: 262 - protein, 8 aa, Artificial Sequence
  Description of Artificial Sequence: Synthetic peptide
KPLGLKAQ

SEQ ID NO: 263 - protein, 8 aa, Artificial Sequence
  Description of Artificial Sequence: Synthetic peptide
FPLGLKAQ

SEQ ID NO: 264 - protein, 8 aa, Artificial Sequence
  Description of Artificial Sequence: Synthetic peptide
HPLGLKAQ

SEQ ID NO: 265 - protein, 8 aa, Artificial Sequence
  Description of Artificial Sequence: Synthetic peptide
PPLGLKAQ

SEQ ID NO: 266 - protein, 8 aa, Artificial Sequence
  Description of Artificial Sequence: Synthetic peptide
APLGLKAQ

SEQ ID NO: 267 - protein, 8 aa, Artificial Sequence
  Description of Artificial Sequence: Synthetic peptide
DPLGLKAQ

SEQ ID NO: 268 - protein, 8 aa, Artificial Sequence
  Description of Artificial Sequence: Synthetic peptide
GPHGLKAQ

SEQ ID NO: 269 - protein, 8 aa, Artificial Sequence
  Description of Artificial Sequence: Synthetic peptide
GPSGLKAQ

SEQ ID NO: 270 - protein, 8 aa, Artificial Sequence
  Description of Artificial Sequence: Synthetic peptide
GPQGLKAQ

SEQ ID NO: 271 - protein, 8 aa, Artificial Sequence
  Description of Artificial Sequence: Synthetic peptide
GPPGLKAQ

SEQ ID NO: 272 - protein, 8 aa, Artificial Sequence
  Description of Artificial Sequence: Synthetic peptide
GPEGLKAQ

SEQ ID NO: 273 - protein, 8 aa, Artificial Sequence
  Description of Artificial Sequence: Synthetic peptide
GPFGLKAQ

SEQ ID NO: 274 - protein, 8 aa, Artificial Sequence
  Description of Artificial Sequence: Synthetic peptide
GPRGLKAQ

SEQ ID NO: 275 - protein, 8 aa, Artificial Sequence
  Description of Artificial Sequence: Synthetic peptide
GPGGLKAQ

SEQ ID NO: 276 - protein, 8 aa, Artificial Sequence
  Description of Artificial Sequence: Synthetic peptide
GPAGLKAQ

SEQ ID NO: 277 - protein, 8 aa, Artificial Sequence
  Description of Artificial Sequence: Synthetic peptide
LPAGLKGA

SEQ ID NO: 278 - protein, 8 aa, Artificial Sequence
  Description of Artificial Sequence: Synthetic peptide
GPANLVAQ

SEQ ID NO: 279 - protein, 8 aa, Artificial Sequence
  Description of Artificial Sequence: Synthetic peptide
GPAALVGA

SEQ ID NO: 280 - protein, 8 aa, Artificial Sequence
  Description of Artificial Sequence: Synthetic peptide
GPANLRAQ

SEQ ID NO: 281 - protein, 8 aa, Artificial Sequence
  Description of Artificial Sequence: Synthetic peptide
GPAGLRAQ

SEQ ID NO: 282 - protein, 8 aa, Artificial Sequence
  Description of Artificial Sequence: Synthetic peptide
GPAGLVAQ

SEQ ID NO: 283 - protein, 8 aa, Artificial Sequence
  Description of Artificial Sequence: Synthetic peptide
GPAGLRGA

SEQ ID NO: 284 - protein, 8 aa, Artificial Sequence
  Description of Artificial Sequence: Synthetic peptide
LPAGLVGA

SEQ ID NO: 285 - protein, 8 aa, Artificial Sequence
  Description of Artificial Sequence: Synthetic peptide
GPAGLKGA

SEQ ID NO: 286 - protein, 8 aa, Artificial Sequence
  Description of Artificial Sequence: Synthetic peptide
GPLALKAQ

SEQ ID NO: 287 - protein, 8 aa, Artificial Sequence
  Description of Artificial Sequence: Synthetic peptide
GPLNLKAQ

SEQ ID NO: 288 - protein, 8 aa, Artificial Sequence
  Description of Artificial Sequence: Synthetic peptide
GPLHLKAQ

SEQ ID NO: 289 - protein, 8 aa, Artificial Sequence
  Description of Artificial Sequence: Synthetic peptide
GPLYLKAQ

SEQ ID NO: 290 - protein, 8 aa, Artificial Sequence
  Description of Artificial Sequence: Synthetic peptide
GPLPLKAQ

SEQ ID NO: 291 - protein, 8 aa, Artificial Sequence
  Description of Artificial Sequence: Synthetic peptide
GPLELKAQ

SEQ ID NO: 292 - protein, 8 aa, Artificial Sequence
  Description of Artificial Sequence: Synthetic peptide
GPLRLKAQ

SEQ ID NO: 293 - protein, 8 aa, Artificial Sequence
  Description of Artificial Sequence: Synthetic peptide
GPLLLKAQ

SEQ ID NO: 294 - protein, 8 aa, Artificial Sequence
  Description of Artificial Sequence: Synthetic peptide
GPLSLKAQ

SEQ ID NO: 295 - protein, 8 aa, Artificial Sequence
  Description of Artificial Sequence: Synthetic peptide
GPLGLYAQ

SEQ ID NO: 296 - protein, 8 aa, Artificial Sequence
  Description of Artificial Sequence: Synthetic peptide
GPLGLFAQ

SEQ ID NO: 297 - protein, 8 aa, Artificial Sequence
  Description of Artificial Sequence: Synthetic peptide
GPLGLLAQ

SEQ ID NO: 298 - protein, 8 aa, Artificial Sequence
  Description of Artificial Sequence: Synthetic peptide
GPLGLHAQ

SEQ ID NO: 299 - protein, 8 aa, Artificial Sequence
  Description of Artificial Sequence: Synthetic peptide
GPLGLRAQ

SEQ ID NO: 300 - protein, 8 aa, Artificial Sequence
  Description of Artificial Sequence: Synthetic peptide
GPLGLAAQ

SEQ ID NO: 301 - protein, 8 aa, Artificial Sequence
  Description of Artificial Sequence: Synthetic peptide
GPLGLEAQ

SEQ ID NO: 302 - protein, 8 aa, Artificial Sequence
  Description of Artificial Sequence: Synthetic peptide
GPLGLGAQ

SEQ ID NO: 303 - protein, 8 aa, Artificial Sequence
  Description of Artificial Sequence: Synthetic peptide
GPLGLPAQ

SEQ ID NO: 304 - protein, 8 aa, Artificial Sequence
  Description of Artificial Sequence: Synthetic peptide
GPLGLQAQ

SEQ ID NO: 305 - protein, 8 aa, Artificial Sequence
  Description of Artificial Sequence: Synthetic peptide
GPLGLSAQ

SEQ ID NO: 306 - protein, 8 aa, Artificial Sequence
  Description of Artificial Sequence: Synthetic peptide
GPLGLVAQ

SEQ ID NO: 307 - protein, 8 aa, Artificial Sequence
  Description of Artificial Sequence: Synthetic peptide
GPLGLKLQ

SEQ ID NO: 308 - protein, 8 aa, Artificial Sequence
  Description of Artificial Sequence: Synthetic peptide
GPLGLKFQ

SEQ ID NO: 309 - protein, 8 aa, Artificial Sequence
  Description of Artificial Sequence: Synthetic peptide
GPLGLKEQ

SEQ ID NO: 310 - protein, 8 aa, Artificial Sequence
  Description of Artificial Sequence: Synthetic peptide
GPLGLKKQ

SEQ ID NO: 311 - protein, 8 aa, Artificial Sequence
  Description of Artificial Sequence: Synthetic peptide
GPLGLKQQ

SEQ ID NO: 312 - protein, 8 aa, Artificial Sequence
  Description of Artificial Sequence: Synthetic peptide
GPLGLKSQ

SEQ ID NO: 313 - protein, 8 aa, Artificial Sequence
  Description of Artificial Sequence: Synthetic peptide
GPLGLKGQ

SEQ ID NO: 314 - protein, 8 aa, Artificial Sequence
  Description of Artificial Sequence: Synthetic peptide
GPLGLKHQ

SEQ ID NO: 315 - protein, 8 aa, Artificial Sequence
  Description of Artificial Sequence: Synthetic peptide
GPLGLKPQ

SEQ ID NO: 316 - protein, 8 aa, Artificial Sequence
  Description of Artificial Sequence: Synthetic peptide
GPLGLKAG

SEQ ID NO: 317 - protein, 8 aa, Artificial Sequence
  Description of Artificial Sequence: Synthetic peptide
GPLGLKAF

SEQ ID NO: 318 - protein, 8 aa, Artificial Sequence
  Description of Artificial Sequence: Synthetic peptide
GPLGLKAP

SEQ ID NO: 319 - protein, 8 aa, Artificial Sequence
  Description of Artificial Sequence: Synthetic peptide
GPLGLKAL

SEQ ID NO: 320 - protein, 8 aa, Artificial Sequence
  Description of Artificial Sequence: Synthetic peptide
GPLGLKAE

SEQ ID NO: 321 - protein, 8 aa, Artificial Sequence
  Description of Artificial Sequence: Synthetic peptide
GPLGLKAA

SEQ ID NO: 322 - protein, 8 aa, Artificial Sequence
  Description of Artificial Sequence: Synthetic peptide
GPLGLKAH

SEQ ID NO: 323 - protein, 8 aa, Artificial Sequence
  Description of Artificial Sequence: Synthetic peptide
GPLGLKAK

SEQ ID NO: 324 - protein, 8 aa, Artificial Sequence
  Description of Artificial Sequence: Synthetic peptide
GPLGLKAS

SEQ ID NO: 325 - protein, 8 aa, Artificial Sequence
  Description of Artificial Sequence: Synthetic peptide
GPLGLFGA

SEQ ID NO: 326 - protein, 8 aa, Artificial Sequence
  Description of Artificial Sequence: Synthetic peptide
GPLGLQGA

SEQ ID NO: 327 - protein, 8 aa, Artificial Sequence
  Description of Artificial Sequence: Synthetic peptide
GPLGLVGA

SEQ ID NO: 328 - protein, 8 aa, Artificial Sequence
  Description of Artificial Sequence: Synthetic peptide
GPLGLAGA

SEQ ID NO: 329 - protein, 8 aa, Artificial Sequence
  Description of Artificial Sequence: Synthetic peptide
GPLGLLGA

SEQ ID NO: 330 - protein, 8 aa, Artificial Sequence
  Description of Artificial Sequence: Synthetic peptide
GPLGLRGA

SEQ ID NO: 331 - protein, 8 aa, Artificial Sequence
  Description of Artificial Sequence: Synthetic peptide
GPLGLYGA

SEQ ID NO: 332 - protein, 8 aa, Artificial Sequence
  Description of Artificial Sequence: Synthetic peptide
ALFKSSPP

SEQ ID NO: 333 - protein, 8 aa, Artificial Sequence
  Description of Artificial Sequence: Synthetic peptide
SPFRSSRQ

SEQ ID NO: 334 - protein, 8 aa, Artificial Sequence
  Description of Artificial Sequence: Synthetic peptide
KLFKSSPP

SEQ ID NO: 335 - protein, 8 aa, Artificial Sequence
  Description of Artificial Sequence: Synthetic peptide
HLFKSSPP

SEQ ID NO: 336 - protein, 8 aa, Artificial Sequence
  Description of Artificial Sequence: Synthetic peptide
SLFKSSPP

SEQ ID NO: 337 - protein, 8 aa, Artificial Sequence
  Description of Artificial Sequence: Synthetic peptide
QLFKSSPP

SEQ ID NO: 338 - protein, 8 aa, Artificial Sequence
  Description of Artificial Sequence: Synthetic peptide
LLFKSSPP

SEQ ID NO: 339 - protein, 8 aa, Artificial Sequence
  Description of Artificial Sequence: Synthetic peptide
PLFKSSPP

SEQ ID NO: 340 - protein, 8 aa, Artificial Sequence
  Description of Artificial Sequence: Synthetic peptide
FLFKSSPP

SEQ ID NO: 341 - protein, 8 aa, Artificial Sequence
  Description of Artificial Sequence: Synthetic peptide
GLFKSSPP

SEQ ID NO: 342 - protein, 8 aa, Artificial Sequence
  Description of Artificial Sequence: Synthetic peptide
VLFKSSPP

SEQ ID NO: 343 - protein, 8 aa, Artificial Sequence
  Description of Artificial Sequence: Synthetic peptide
ELFKSSPP

SEQ ID NO: 344 - protein, 8 aa, Artificial Sequence
  Description of Artificial Sequence: Synthetic peptide
AKFKSSPP

SEQ ID NO: 345 - protein, 8 aa, Artificial Sequence
  Description of Artificial Sequence: Synthetic peptide
AHFKSSPP

SEQ ID NO: 346 - protein, 8 aa, Artificial Sequence
  Description of Artificial Sequence: Synthetic peptide
AGFKSSPP

SEQ ID NO: 347 - protein, 8 aa, Artificial Sequence
  Description of Artificial Sequence: Synthetic peptide
APFKSSPP

SEQ ID NO: 348 - protein, 8 aa, Artificial Sequence
  Description of Artificial Sequence: Synthetic peptide
ANFKSSPP

SEQ ID NO: 349 - protein, 8 aa, Artificial Sequence
  Description of Artificial Sequence: Synthetic peptide
AFFKSSPP

SEQ ID NO: 350 - protein, 8 aa, Artificial Sequence
  Description of Artificial Sequence: Synthetic peptide
AAFKSSPP

SEQ ID NO: 351 - protein, 8 aa, Artificial Sequence
  Description of Artificial Sequence: Synthetic peptide
ASFKSSPP

SEQ ID NO: 352 - protein, 8 aa, Artificial Sequence
  Description of Artificial Sequence: Synthetic peptide
AEFKSSPP

SEQ ID NO: 353 - protein, 8 aa, Artificial Sequence
  Description of Artificial Sequence: Synthetic peptide
ALRKSSPP

SEQ ID NO: 354 - protein, 8 aa, Artificial Sequence
  Description of Artificial Sequence: Synthetic peptide
ALLKSSPP

SEQ ID NO: 355 - protein, 8 aa, Artificial Sequence
  Description of Artificial Sequence: Synthetic peptide
ALAKSSPP

SEQ ID NO: 356 - protein, 8 aa, Artificial Sequence
  Description of Artificial Sequence: Synthetic peptide
ALQKSSPP

SEQ ID NO: 357 - protein, 8 aa, Artificial Sequence
  Description of Artificial Sequence: Synthetic peptide
ALHKSSPP

SEQ ID NO: 358 - protein, 8 aa, Artificial Sequence
  Description of Artificial Sequence: Synthetic peptide
ALPKSSPP

SEQ ID NO: 359 - protein, 8 aa, Artificial Sequence
  Description of Artificial Sequence: Synthetic peptide
ALTKSSPP

SEQ ID NO: 360 - protein, 8 aa, Artificial Sequence
  Description of Artificial Sequence: Synthetic peptide
ALGKSSPP

SEQ ID NO: 361 - protein, 8 aa, Artificial Sequence
  Description of Artificial Sequence: Synthetic peptide
ALDKSSPP

SEQ ID NO: 362 - protein, 8 aa, Artificial Sequence
  Description of Artificial Sequence: Synthetic peptide
ALFHSSPP

SEQ ID NO: 363 - protein, 8 aa, Artificial Sequence
  Description of Artificial Sequence: Synthetic peptide
ALFTSSPP

SEQ ID NO: 364 - protein, 8 aa, Artificial Sequence
  Description of Artificial Sequence: Synthetic peptide
ALFASSPP

SEQ ID NO: 365 - protein, 8 aa, Artificial Sequence
  Description of Artificial Sequence: Synthetic peptide
ALFQSSPP

SEQ ID NO: 366 - protein, 8 aa, Artificial Sequence
  Description of Artificial Sequence: Synthetic peptide
ALFLSSPP

SEQ ID NO: 367 - protein, 8 aa, Artificial Sequence
  Description of Artificial Sequence: Synthetic peptide
ALFGSSPP

SEQ ID NO: 368 - protein, 8 aa, Artificial Sequence
  Description of Artificial Sequence: Synthetic peptide
ALFESSPP

SEQ ID NO: 369 - protein, 8 aa, Artificial Sequence
  Description of Artificial Sequence: Synthetic peptide
ALFPSSPP

SEQ ID NO: 370 - protein, 8 aa, Artificial Sequence
  Description of Artificial Sequence: Synthetic peptide
ALFKHSPP

SEQ ID NO: 371 - protein, 8 aa, Artificial Sequence
  Description of Artificial Sequence: Synthetic peptide
ALFKLSPP

SEQ ID NO: 372 - protein, 8 aa, Artificial Sequence
  Description of Artificial Sequence: Synthetic peptide
ALFKKSPP

SEQ ID NO: 373 - protein, 8 aa, Artificial Sequence
  Description of Artificial Sequence: Synthetic peptide
ALFKASPP

SEQ ID NO: 374 - protein, 8 aa, Artificial Sequence
  Description of Artificial Sequence: Synthetic peptide
ALFKISPP

SEQ ID NO: 375 - protein, 8 aa, Artificial Sequence
  Description of Artificial Sequence: Synthetic peptide
ALFKGSPP

SEQ ID NO: 376 - protein, 8 aa, Artificial Sequence
  Description of Artificial Sequence: Synthetic peptide
ALFKNSPP

SEQ ID NO: 377 - protein, 8 aa, Artificial Sequence
  Description of Artificial Sequence: Synthetic peptide
ALFKRSPP

SEQ ID NO: 378 - protein, 8 aa, Artificial Sequence
  Description of Artificial Sequence: Synthetic peptide
ALFKESPP

SEQ ID NO: 379 - protein, 8 aa, Artificial Sequence
  Description of Artificial Sequence: Synthetic peptide
ALFKFSPP

SEQ ID NO: 380 - protein, 8 aa, Artificial Sequence
  Description of Artificial Sequence: Synthetic peptide
ALFKPSPP

SEQ ID NO: 381 - protein, 8 aa, Artificial Sequence
  Description of Artificial Sequence: Synthetic peptide
ALFKSFPP

SEQ ID NO: 382 - protein, 8 aa, Artificial Sequence
  Description of Artificial Sequence: Synthetic peptide
ALFKSLPP

SEQ ID NO: 383 - protein, 8 aa, Artificial Sequence
  Description of Artificial Sequence: Synthetic peptide
ALFKSIPP

SEQ ID NO: 384 - protein, 8 aa, Artificial Sequence
  Description of Artificial Sequence: Synthetic peptide
ALFKSKPP

SEQ ID NO: 385 - protein, 8 aa, Artificial Sequence
  Description of Artificial Sequence: Synthetic peptide
ALFKSAPP

SEQ ID NO: 386 - protein, 8 aa, Artificial Sequence
  Description of Artificial Sequence: Synthetic peptide
ALFKSQPP

SEQ ID NO: 387 - protein, 8 aa, Artificial Sequence
  Description of Artificial Sequence: Synthetic peptide
ALFKSPPP

SEQ ID NO: 388 - protein, 8 aa, Artificial Sequence
  Description of Artificial Sequence: Synthetic peptide
ALFKSEPP

SEQ ID NO: 389 - protein, 8 aa, Artificial Sequence
  Description of Artificial Sequence: Synthetic peptide
ALFKSGPP

SEQ ID NO: 390 - protein, 8 aa, Artificial Sequence
  Description of Artificial Sequence: Synthetic peptide
ALFKSSLP

SEQ ID NO: 391 - protein, 8 aa, Artificial Sequence
  Description of Artificial Sequence: Synthetic peptide
ALFKSSGP

SEQ ID NO: 392 - protein, 8 aa, Artificial Sequence
  Description of Artificial Sequence: Synthetic peptide
ALFKSSSP

SEQ ID NO: 393 - protein, 8 aa, Artificial Sequence
  Description of Artificial Sequence: Synthetic peptide
ALFKSSVP

SEQ ID NO: 394 - protein, 8 aa, Artificial Sequence
  Description of Artificial Sequence: Synthetic peptide
ALFKSSHP

SEQ ID NO: 395 - protein, 8 aa, Artificial Sequence
  Description of Artificial Sequence: Synthetic peptide
ALFKSSAP

SEQ ID NO: 396 - protein, 8 aa, Artificial Sequence
  Description of Artificial Sequence: Synthetic peptide
ALFKSSNP

SEQ ID NO: 397 - protein, 8 aa, Artificial Sequence
  Description of Artificial Sequence: Synthetic peptide
ALFKSSKP

SEQ ID NO: 398 - protein, 8 aa, Artificial Sequence
  Description of Artificial Sequence: Synthetic peptide
ALFKSSEP

SEQ ID NO: 399 - protein, 8 aa, Artificial Sequence
  Description of Artificial Sequence: Synthetic peptide
ALFKSSPF

SEQ ID NO: 400 - protein, 8 aa, Artificial Sequence
  Description of Artificial Sequence: Synthetic peptide
ALFKSSPH

SEQ ID NO: 401 - protein, 8 aa, Artificial Sequence
  Description of Artificial Sequence: Synthetic peptide
ALFKSSPG

SEQ ID NO: 402 - protein, 8 aa, Artificial Sequence
  Description of Artificial Sequence: Synthetic peptide
ALFKSSPA

SEQ ID NO: 403 - protein, 8 aa, Artificial Sequence
  Description of Artificial Sequence: Synthetic peptide
ALFKSSPS

SEQ ID NO: 404 - protein, 8 aa, Artificial Sequence
  Description of Artificial Sequence: Synthetic peptide
ALFKSSPV

SEQ ID NO: 405 - protein, 8 aa, Artificial Sequence
  Description of Artificial Sequence: Synthetic peptide
ALFKSSPQ

SEQ ID NO: 406 - protein, 8 aa, Artificial Sequence
  Description of Artificial Sequence: Synthetic peptide
ALFKSSPK

SEQ ID NO: 407 - protein, 8 aa, Artificial Sequence
  Description of Artificial Sequence: Synthetic peptide
ALFKSSPL

SEQ ID NO: 408 - protein, 8 aa, Artificial Sequence
  Description of Artificial Sequence: Synthetic peptide
ALFKSSPD

The invention claimed is:

1. A recombinant pro-protein comprising:
   a. a recombinant polypeptide comprising, a cleavable moiety that is a substrate for a protease, wherein the cleavable moiety comprises the amino acid sequence of SEQ ID NO: 198 or a functional variant of SEQ ID NO: 198 in which one or two amino acids are substituted in SEQ ID NO: 198; and
   b. a polypeptide with biological activity.

2. The recombinant pro-protein of claim 1, wherein the polypeptide with biological activity comprises a cytokine, chemokine, growth factor, a soluble receptor, antigen-binding polypeptide, an antibody or an antigen-binding portion thereof, or a combination thereof.

3. The recombinant pro-protein of claim 1, wherein the cleavable moiety that is a substrate for a protease comprises SEQ ID NO: 198 in which one or two amino acids are substituted in SEQ ID NO: 198 with the proviso that the amino acid at positions 4 and 5 of SEQ ID NO: 198 are not substituted.

4. The recombinant pro-protein of claim 1, wherein the cleavable moiety that is a substrate for a protease links the polypeptide with biological activity to another amino acid sequence.

5. The recombinant pro-protein of claim 1, wherein the pro-protein has attenuated biological activity, and wherein cleavage of the cleavable moiety by the protease produces a polypeptide with biological activity that is not attenuated.

6. The recombinant pro-protein of claim 1, further comprising a blocking moiety selected from a steric blocking moiety, a specific blocking moiety, and a combination thereof.

7. The recombinant pro-protein of claim 6, wherein the blocking moiety comprises a steric blocking moiety that comprises human serum albumin (HSA), an anti-HSA antibody, an immunoglobulin Fc, or a fragment of any of the foregoing.

8. The recombinant pro-protein of claim 6, wherein the blocking moiety comprises a specific blocking moiety that comprises an antibody that has binding specificity for the biologically active polypeptide or an antigen-binding fragment thereof, or the ligand-binding portion of a receptor that has binding specificity for the biologically active polypeptide or a ligand-binding fragment thereof.

9. The recombinant pro-protein of claim 1, further comprising a half-life extension domain.

10. The recombinant pro-protein of claim 1, wherein the polypeptide with biological activity comprises at least one of an extracellular domain, a transmembrane domain, and an intracellular domain.

11. The recombinant pro-protein of claim 1, wherein the polypeptide with biological activity comprises a cell surface receptor, a chimeric antigen receptor (CAR), or a T Cell Receptor (TCR) subunit.

12. The recombinant pro-protein of claim 1, wherein the cleavable moiety comprises the amino acid sequence of SEQ ID NO: 198 in which one amino acid is substituted.

13. The recombinant pro-protein of claim 1, wherein the cleavable moiety comprises the amino acid sequence of SEQ ID NO: 198 in which two amino acids are substituted.

14. The recombinant pro-protein of claim 1, wherein the one or two amino acid substitutions in the functional variant of SEQ ID NO: 198 are conservative substitutions.

15. The recombinant pro-protein of claim 1, wherein the functional variant of SEQ ID NO: 198 comprises the amino acid sequence of SEQ ID NO: 199, SEQ ID NO: 370, SEQ ID NO: 381, SEQ ID NO: 382, SEQ ID NO: 383, or SEQ ID NO: 390.

16. The recombinant pro-protein of claim 1, wherein the functional variant of SEQ ID NO: 198 is a substrate for Cathepsin L.

\* \* \* \* \*